(12) United States Patent
Ganguli et al.

(10) Patent No.: US 11,702,686 B1
(45) Date of Patent: *Jul. 18, 2023

(54) COMPOSITIONS OF MATTER FOR DETECTION ASSAYS

(71) Applicants: LabSimply, Inc., San Diego, CA (US); The Board of Trustees of the University of Illinois, Urbana, IL (US)

(72) Inventors: Anurup Ganguli, San Diego, CA (US); Ariana Mostafa, San Diego, CA (US); Jacob Berger, San Diego, CA (US); Ashish Pandey, San Diego, CA (US); Rashid Bashir, Urbana, IL (US)

(73) Assignees: LabSimply, Inc., San Diego, CA (US); The Board of Trustees of the University of Illinois, Urbana, IL (US)

(*) Notice: Subject to any disclaimer, the term of this patent is extended or adjusted under 35 U.S.C. 154(b) by 0 days.

This patent is subject to a terminal disclaimer.

(21) Appl. No.: 18/106,420

(22) Filed: Feb. 6, 2023

Related U.S. Application Data

(63) Continuation of application No. 17/861,208, filed on Jul. 9, 2022, now Pat. No. 11,639,520.

(60) Provisional application No. 63/289,112, filed on Dec. 13, 2021, provisional application No. 63/220,987, filed on Jul. 12, 2021.

(51) Int. Cl.
| | |
|---|---|
| *C12Q 1/6823* | (2018.01) |
| *C12N 9/22* | (2006.01) |
| *C12N 15/11* | (2006.01) |
| *C12Q 1/6806* | (2018.01) |
| *C12Q 1/682* | (2018.01) |

(52) U.S. Cl.
CPC ............. *C12Q 1/6823* (2013.01); *C12N 9/22* (2013.01); *C12N 15/11* (2013.01); *C12Q 1/682* (2013.01); *C12Q 1/6806* (2013.01); *C12N 2310/20* (2017.05); *C12N 2310/315* (2013.01); *C12N 2310/321* (2013.01); *C12N 2310/3231* (2013.01); *C12N 2320/10* (2013.01)

(58) Field of Classification Search
None
See application file for complete search history.

(56) References Cited

U.S. PATENT DOCUMENTS

| | | | |
|---|---|---|---|
| 10,253,365 | B1 | 4/2019 | Doudna et al. |
| 10,266,886 | B2 | 4/2019 | Abudayyeh et al. |
| 10,266,887 | B2 | 4/2019 | Abudayyeh et al. |
| 10,337,051 | B2 | 7/2019 | Doudna et al. |
| 10,494,664 | B2 | 12/2019 | Doudna et al. |
| 11,021,740 | B2 | 6/2021 | Abudayyeh et al. |
| 11,060,115 | B2 | 7/2021 | Severinov et al. |
| 11,104,937 | B2 | 8/2021 | Abudayyeh et al. |
| 11,118,224 | B2 | 9/2021 | Doudna et al. |
| 11,174,515 | B2 | 11/2021 | Abudayyeh et al. |
| 11,421,250 | B2 | 8/2022 | Severinov et al. |
| 11,447,824 | B2 | 9/2022 | Doudna et al. |
| 2018/0282722 | A1 | 10/2018 | Jakimo et al. |
| 2019/0241954 | A1 | 8/2019 | Doudna et al. |
| 2019/0256900 | A1 | 8/2019 | Zhang et al. |
| 2020/0010879 | A1 | 1/2020 | Doudna et al. |
| 2020/0056167 | A1 | 2/2020 | Dong et al. |
| 2020/0165594 | A1 | 5/2020 | Zhang et al. |
| 2020/0277600 | A1 | 9/2020 | Zhang et al. |
| 2020/0392473 | A1 | 12/2020 | Zhang et al. |
| 2021/0102242 | A1 | 4/2021 | Chen et al. |
| 2021/0108267 | A1 | 4/2021 | Zhang et al. |
| 2021/0166783 | A1 | 6/2021 | Shmakov et al. |
| 2021/0269866 | A1 | 9/2021 | Zhang et al. |
| 2021/0317527 | A1 | 10/2021 | Doudna et al. |
| 2021/0388437 | A1 | 12/2021 | Doudna et al. |
| 2022/0025463 | A1 | 1/2022 | Abudayyeh et al. |
| 2022/0333208 | A1 | 10/2022 | Gootenberg et al. |

FOREIGN PATENT DOCUMENTS

| | | |
|---|---|---|
| WO | WO 2020/191248 | 9/2020 |
| WO | WO 2020/191376 | 9/2020 |

OTHER PUBLICATIONS

Fozouni, et al., "Amplification-free detection of SARS-CoV-2 with CRISPR-Cas13a and mobile phone microscopy", Cell, doi.org/10.1016/j.cell.2020.12.001, pp. 323-333, Jan. 21, 2021.

Kaminski, et al., "CRISPR-based diagnostics", Nature Biomedical Engineering, vol. 5, doi.org/10.1038/s41551-021-00760-7, pp. 643-656, Jul. 2021.

Zhou, et al., "CRISPR/Cas13a Powered Portable Electrochemiluminescence Chip for Ultrasensitive and Specific MiRNA Detection", Advanced Science News, doi: 10.1002/advs.201903661, pp. 1-10, 2020.

Zhao, et al., "CRISPR-Cas13a system: A novel tool for molecular diagnostics", Frontiers in Microbiology, doi:10.3389/fmicb.2022.1060947, pp. 1-18, Dec. 8, 2022.

(Continued)

*Primary Examiner* — Suzanne M Noakes
*Assistant Examiner* — Jae W Lee
(74) *Attorney, Agent, or Firm* — Sarah Brashears

(57) ABSTRACT

The present disclosure describes compositions of matter comprising a ribonucleoprotein complex comprising a nucleic acid-guided nuclease and a guide RNA, and further comprising and a blocking nucleic acid molecule represented by Formula I, wherein Formula I in the 5'-to-3' direction comprises: A-(B-L)$_J$-C-M-T-D; wherein A is 0-15 nucleotides in length; B is 4-12 nucleotides in length; L is 3-25 nucleotides in length; J is an integer between 1 and 10; C is 4-15 nucleotides in length; M is 1-25 nucleotides in length or is absent, wherein if M is absent then A-(B-L)$_J$-C and T-D are separate nucleic acid strands; T is 17-135 nucleotides in length and comprises at least 50% sequence complementarity to B and C; D is 0-10 nucleotides in length and comprises at least 50% sequence complementarity to A; and wherein the blocking nucleic acid molecule comprises a sequence complementary to a gRNA.

28 Claims, 24 Drawing Sheets

Specification includes a Sequence Listing.

(56) References Cited

OTHER PUBLICATIONS

Zhou, et al., "A Decade of CRISPR Gene Editing in China and Beyond: A Scientometric Landscape", The CRISPR Journal, vol. 4, No. 3, doi:10.1089/crispr.2020.0148, pp. 313-320, 2021.

Shinoda, et al., "Automated amplification-free digital RNA detection platform for rapid and sensitive SARS-CoV-2 diagnosis", Communications Biology, doi.org/10.1038/s42003-022-03433-6, pp. 1-8, May 26, 2022.

Gupta, et al., "Cas13d: A New Molecular Scissor for Transcriptome Engineering", Frontiers in Cell and Developmental Biology, vol. 10, doi:10.3389/fcell.2022.866800, pp. 1-22, Mar. 31, 2022.

Schunder, et al., "First indication for a functional CRISPR/Cas system in Francisella tularensis", International Journal of Medical Microbiology, vol. 303, Issue 2, doi:10.1016/j.ijmm.2012.11.004, pp. 1-29, Mar. 2013.

Sha, et al., "Cascade CRISPR/cas enables amplification-free microRNA sensing with fM-sensitivity and single-base-specificity", ChemComm, doi:10.1039/d0cc06412b, pp. 247-250 and 1-15, 2021.

Yang, et al., "Engineered LwaCas13a with enhanced collateral activity for nucleic acid detection", Nature Chemical Biology, vol. 19, doi:10.1038/s41589-022-01135-y, pp. 45-54, Jan. 2023.

Li, et al., "Applying CRISPR-Cas12a as Signal Amplifier to Construct Biosensors for Non-DNA Targets in Ultra-low Concentrations", ACS Sensors, doi: 10.1021/acssensors.9b02305, pp. 1-23, Mar. 12, 2020.

Kim, et al., "Chimeric crRNAs with 19 DNA residues in the guide region show retained DNA cleavage activity of Cas9 with a potential to improve the specificity", The Royal Society of Chemistry, pp. 1-16, 2019.

Kim, et al., "Enhancement of target specificity of CRISPR-Cas12a by using a chimeric DNA-RNA guide", Nucleic Acids Research, doi: 10.1093/nar/gkaa605, vol. 48, No. 15, pp. 8601-8616, Jul. 20, 2020.

Swarts, et al., "Mechanistic Insights into the Cis- and Trans-acting Deoxyribonuclease Activities of Cas12a", Mol Cell, doi: 10.1016/j.molcel.2018.11.021, pp. 1-28, Feb. 7, 2019.

Nguyen, et al., "Enhancement of trans-cleavage activity of Cas12a with engineered crRNA enables amplified nucleic acid detection", Nature Communications, doi: 10.1038/s41467-020-18615-1, pp. 1-13, 2020.

Ooi, et al., "An engineered CRISPR-Cas12a variant and DNA-RNA hybrid guides enable robust and rapid COVID-10 testing", Nature Communications, doi: 10.1038/s41467-021-21996-6, pp. 1-23, 2021.

Shi, et al., "A CRISPR-Cas autocatalysis-driven feedback amplification network for supersensitive DNA diagnostics", Science Advances, doi: 10.1126/sciadv.abc7802, pp. 1-9, Jan. 27, 2021.

The Board of Trustees of the University of Illinois, "CRISPR Cascade", International PCT Application No. PCT/US22/33985, filed Jun. 17, 2022.

Chen, et al., "CRISPR-Cas12a target binding unleashes indiscriminate single-stranded DNase activity", Howard Hughes Medical Institute, Science, 360(6387), pp. 436-439, Apr. 27, 2018.

Liu, et al., "Accelerated RNA detection using tandem CRISPR nucleases", Nature Chemical Biology, vol. 17, doi:10.1038/s41589-021-0084202, pp. 982-988, Sep. 2021.

Gootenberg, et al., "Nucleic acid detection with CRISPR-Cas13a/C2c2", Science, doi:10.1126/science.aam9321, pp. 438-442, Apr. 28, 2017.

East-Seletsky, et al., "RNA targeting by functionally orthogonal Type VI-A CRISPR-Cas enzymes", Howard Hughes Medical Institute, Mol Cell, pp. 373-383, May 4, 2017.

Schmidt, et al., "Application of locked nucleic acids to improve aptamer in vivo stability and targeting function", Nucleic Acids Research, vol. 32, No. 19, doi:10.1093/nar/gkh862, pp. 5757-5765, Oct. 27, 2004.

Makarova, et al., "Evolutionary classification of CRISPR-Cas systems: a burst of class 2 and derived variants", Nature Reviews | Microbiology, vol. 18, pp. 67-83, Feb. 2020.

Gleditzsch, et al., "PAM identification by CRISPR-Cas effector complexes: diversified mechanisms and structures", RNA Biology, vol. 16, No. 4, doi.org/10.1080/15476286.2018.1504546, pp. 504-517, Jul. 20, 2018.

Kellner, et al., "Sherlock: Nucleic acid detection with CRISPR nucleases", Nat Protoc., doi:10.1038/s41596-019-0210-2, pp. 2986-3012, Oct. 2019.

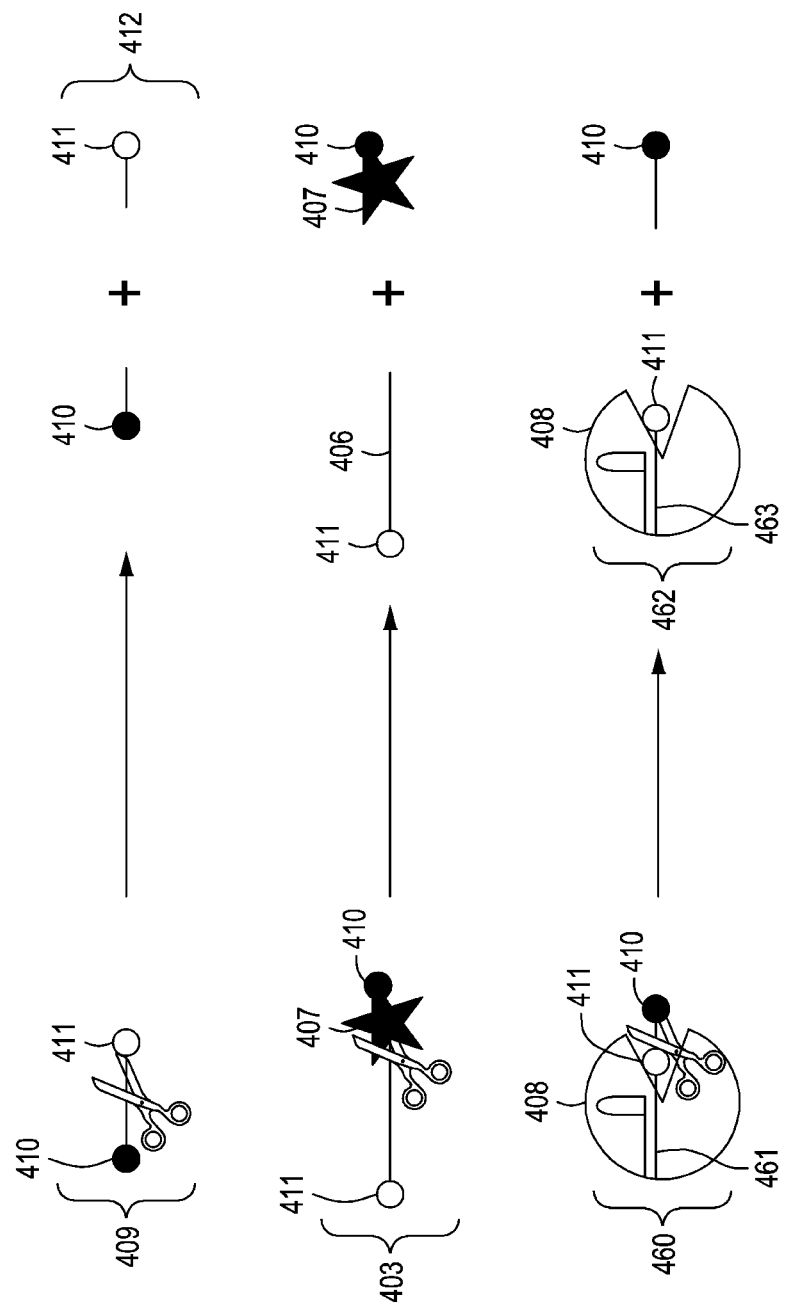

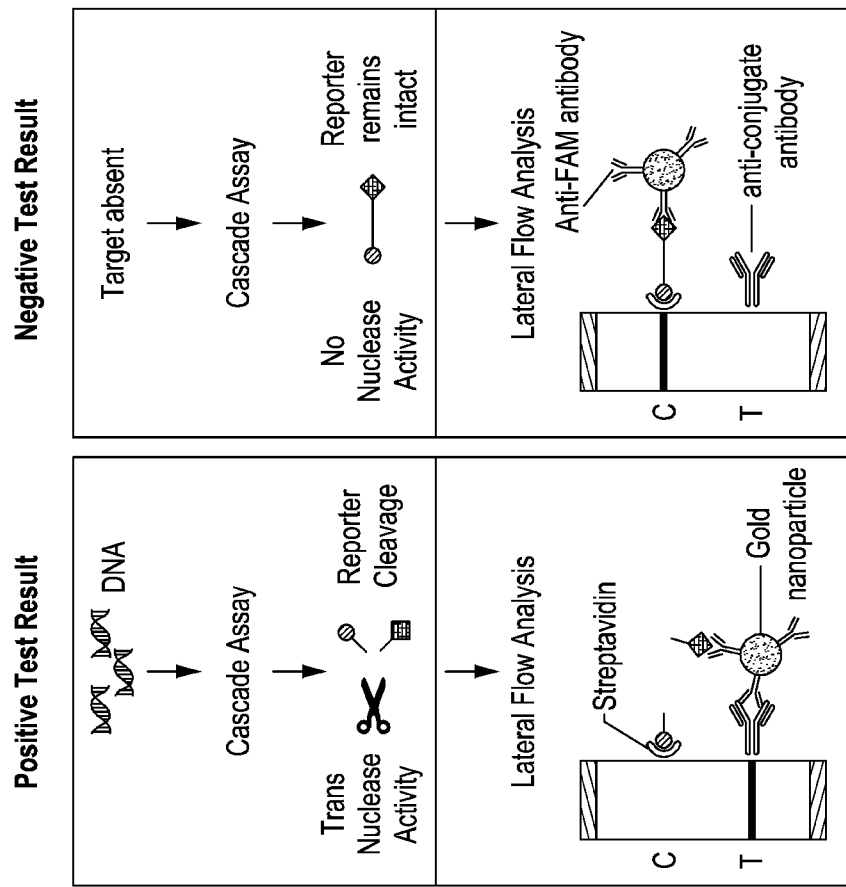
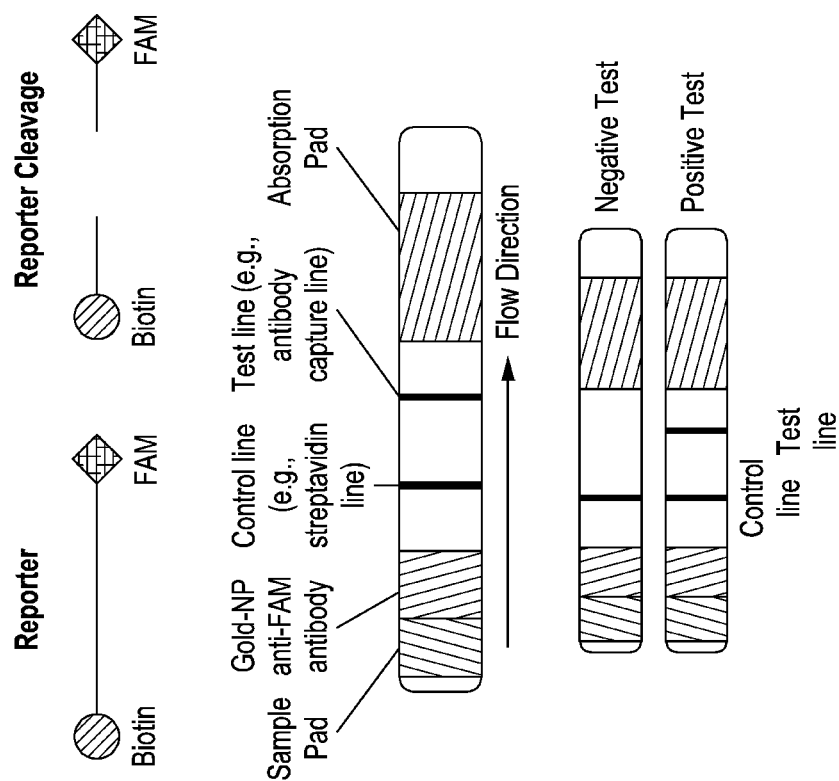
FIG. 5A

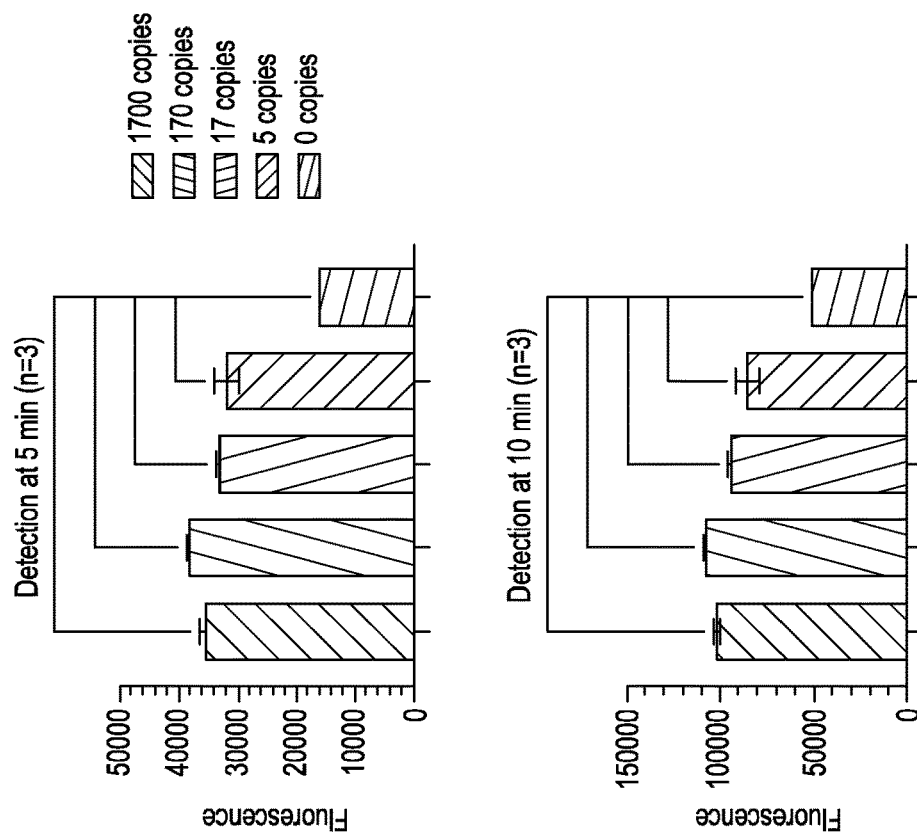
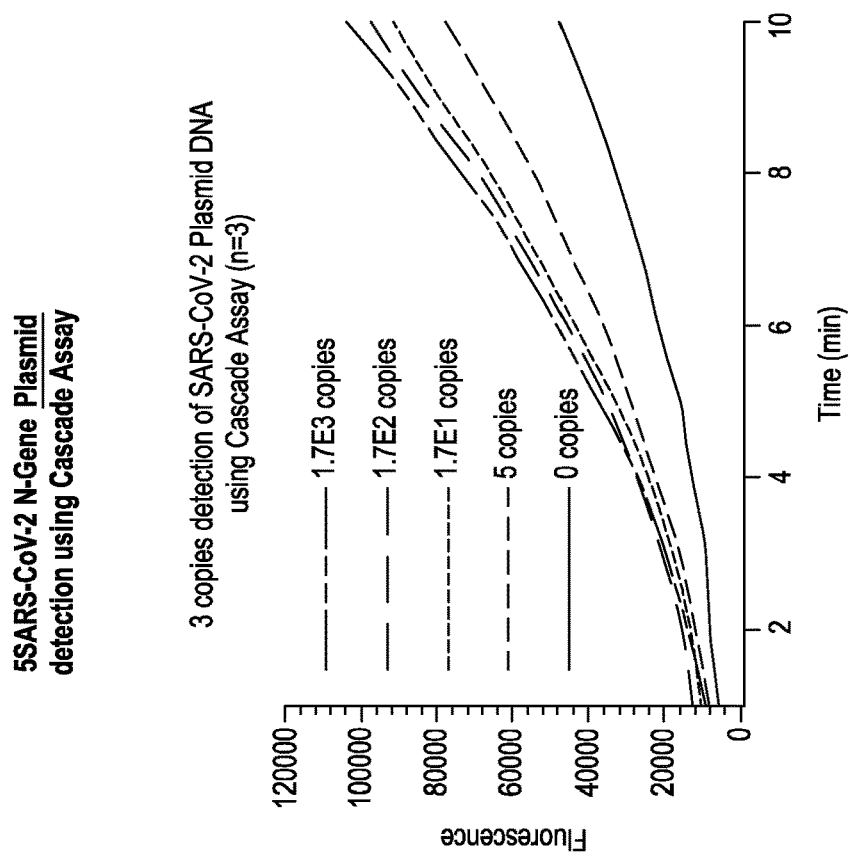
FIG. 6

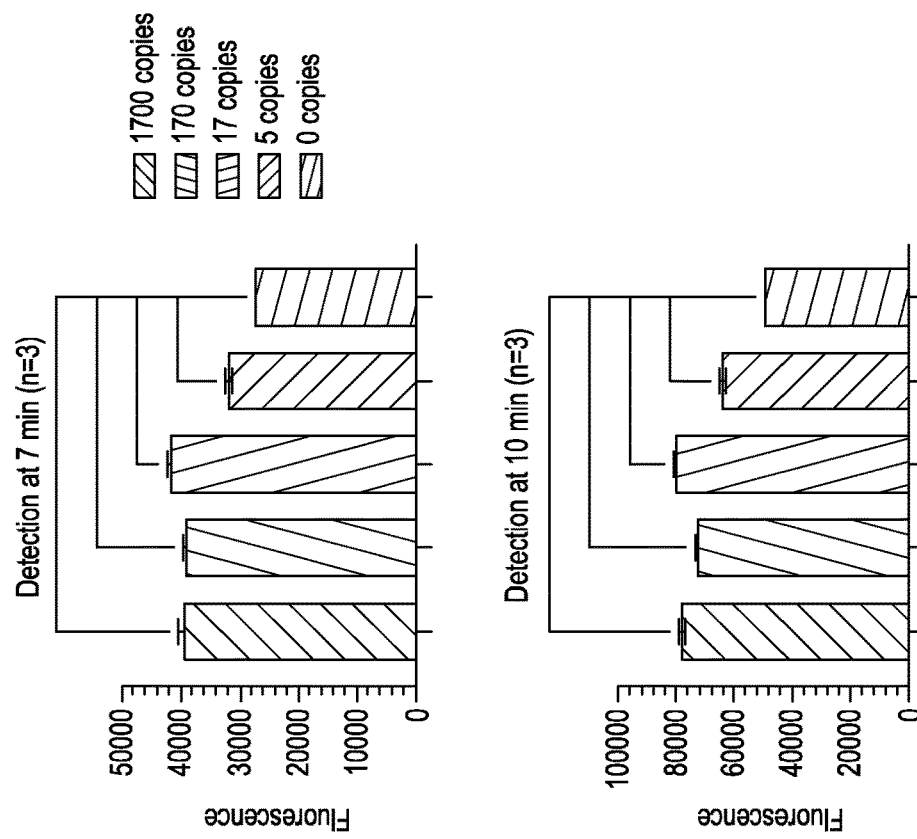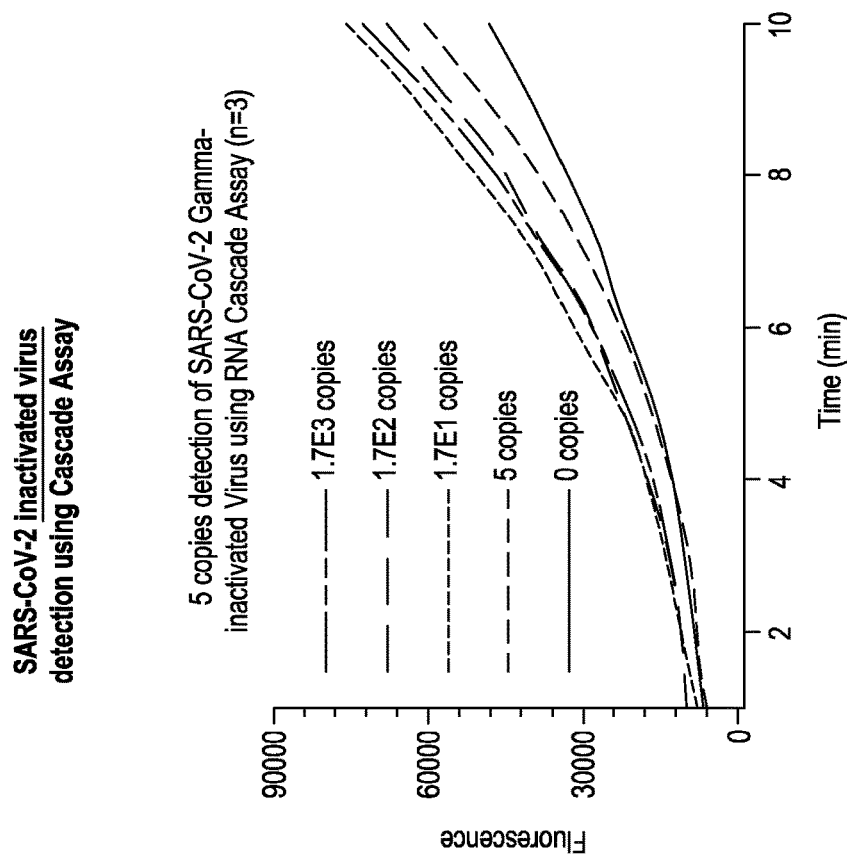
FIG. 7

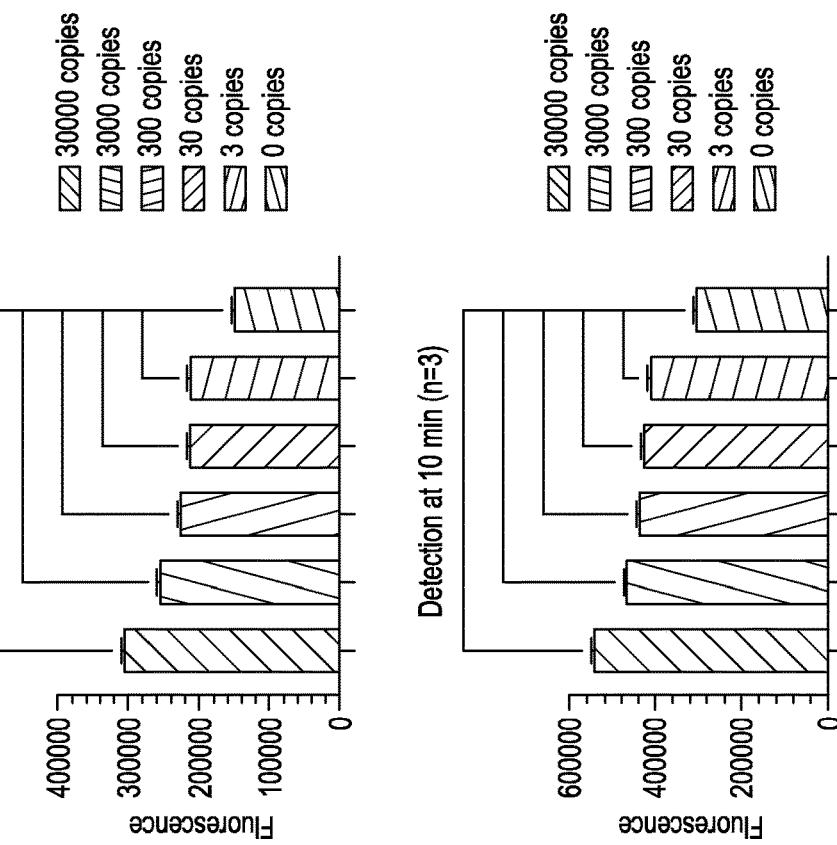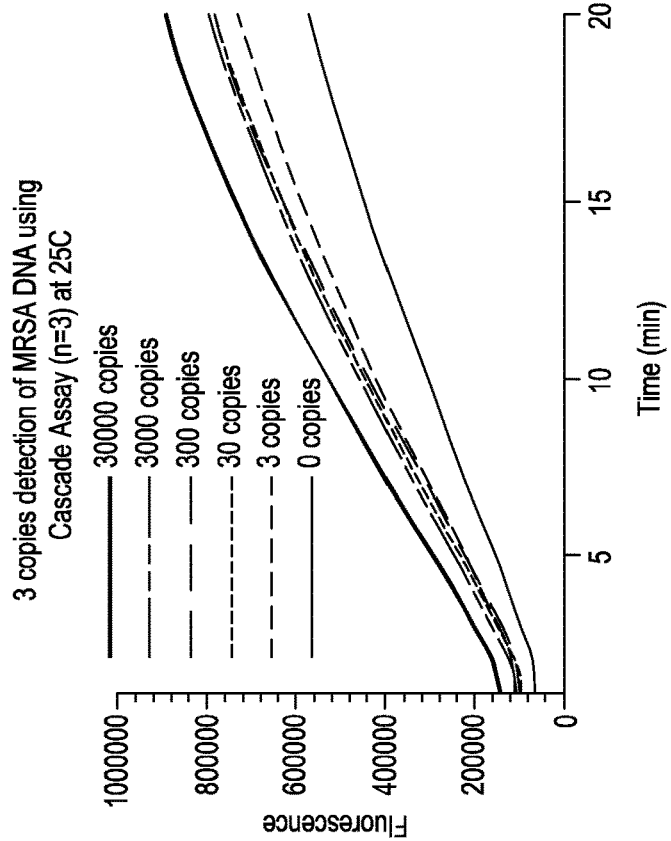
FIG. 9

COMPOSITIONS OF MATTER FOR DETECTION ASSAYS

RELATED APPLICATIONS

This application is a continuation of U.S. Ser. No. 17/861,208, filed 9 Jul. 2022, which claims priority to U.S. Ser. No. 63/220,987, filed 12 Jul. 2021, and U.S. Ser. No. 63/289,112, filed 13 Dec. 2021.

FIELD OF THE INVENTION

The present disclosure relates to methods, compositions of matter and assay systems used to detect one or more target nucleic acids of interest in a sample. The assay systems provide signal amplification upon detection of a target nucleic acids of interest without amplification of the target nucleic acids.

INCORPORATION BY REFERENCE

Submitted on 4 Aug. 2022 is an electronically filed sequence listing via EFS-Web a Sequence Listing XML, entitled "LS002US2_seqlist_20220804", created 4 Aug. 2022, which is 6,799,000 bytes in size. The sequence listing is part of the specification filed 9 Jul. 2022 and is incorporated by reference in its entirety.

BACKGROUND OF THE INVENTION

In the following discussion certain articles and methods will be described for background and introductory purposes. Nothing contained herein is to be construed as an "admission" of prior art. Applicant expressly reserves the right to demonstrate, where appropriate, that the articles and methods referenced herein do not constitute prior art under the applicable statutory provisions.

Rapid and accurate identification of infectious agents is important in order to select correct treatment and prevent further spreading of viral infections and pandemic diseases. For example, viral pathogens, such as SARS-CoV-2, and the associated COVID-19 disease require immediate detection and response to decrease mortality, morbidity and transmission.

Classic nucleic acid-guided nuclease or CRISPR (clustered regularly interspaced short palindromic repeats) detection methods usually rely on pre-amplification of target nucleic acids of interest to enhance detection sensitivity. However, amplification increases time to detection and may cause changes to the relative proportion of nucleic acids in samples that, in turn, lead to artifacts or inaccurate results. Improved technologies that allow very rapid and accurate detection of pathogens are therefore needed for timely diagnosis, prevention and treatment of disease, as well as in other applications.

SUMMARY OF THE INVENTION

This Summary is provided to introduce a selection of concepts in a simplified form that are further described below in the Detailed Description. This Summary is not intended to identify key or essential features of the claimed subject matter, nor is it intended to be used to limit the scope of the claimed subject matter. Other features, details, utilities, and advantages of the claimed subject matter will be apparent from the following written Detailed Description including those aspects illustrated in the accompanying drawings and defined in the appended claims. Further, all of the functionalities described in connection with one embodiment of the compositions and methods described herein are intended to be applicable to the additional embodiments of the compositions and methods described herein except where expressly stated or where the feature or function is incompatible with the additional embodiments. For example, where a given feature or function is expressly described in connection with one embodiment but not expressly mentioned in connection with an alternative embodiment, it should be understood that the feature or function may be deployed, utilized, or implemented in connection with the alternative embodiment unless the feature or function is incompatible with the alternative embodiment.

The present disclosure provides compositions of matter, methods, and cascade assays to detect target nucleic acids of interest. The cascade assays described herein comprise two different ribonucleoprotein complexes and either blocked nucleic acid molecules or blocked primer molecules. The blocked nucleic acid molecules or blocked primer molecules keep one of the ribonucleoprotein complexes "locked" unless and until a target nucleic acid of interest activates the other ribonucleoprotein complex. The present nucleic acid-guided nuclease cascade assay can detect one or more target nucleic acids of interest (e.g., DNA, RNA and/or cDNA) at attamolar (aM) (or lower) limits in about 10 minutes or less without the need for amplifying the target nucleic acid(s) of interest, thereby avoiding the drawbacks of multiplex amplification, such as primer-dimerization. A particularly advantageous feature of the cascade assay is that, with the exception of the gRNA in RNP1, the cascade assay components stay the same no matter what target nucleic acid(s) of interest are being detected. In this sense, the cascade assay is modular.

There is provided herein in one embodiment of the disclosure a reaction mixture comprising: (i) a first ribonucleoprotein (RNP) complex (RNP1) comprising a first nucleic acid-guided nuclease and a first guide RNA (gRNA); wherein the first gRNA comprises a sequence complementary to a target nucleic acid of interest, and wherein the first nucleic acid-guided nuclease exhibits both cis-cleavage activity and trans-cleavage activity; (ii) a second ribonucleoprotein complex (RNP2) comprising a second nucleic acid-guided nuclease and a second gRNA that is not complementary to the target nucleic acid of interest; wherein the second nucleic acid-guided nuclease exhibits both cis-cleavage activity and trans-cleavage activity; and (iii) a plurality of blocked nucleic acid molecules comprising a sequence complementary to the second gRNA, wherein the blocked nucleic acid molecules cannot activate the RNP1 or the RNP2.

There is provided in a second embodiment of the disclosure, a reaction mixture comprising: (i) a first complex comprising a first nucleic acid-guided nuclease and a first guide RNA (gRNA); wherein the first gRNA comprises a sequence complementary to a target nucleic acid of interest, and wherein the first nucleic acid-guided nuclease exhibits both cis-cleavage activity and trans-cleavage activity; (ii) a second complex comprising a second nucleic acid-guided nuclease and a second gRNA that is not complementary to the target nucleic acid of interest; wherein the second nucleic acid-guided nuclease exhibits both cis-cleavage activity and trans-cleavage activity; and (iii) a plurality of blocked nucleic acid molecules comprising a sequence complementary to the second gRNA, wherein the blocked nucleic acid molecule cannot activate the first or second complex.

Provided in a third embodiment is a reaction mixture comprising: (i) a first ribonucleoprotein (RNP) (RNP1) complex comprising a first nucleic acid-guided nuclease and a first guide RNA (gRNA); wherein the first gRNA comprises a sequence complementary to a target nucleic acid of interest, and wherein the first nucleic acid-guided nuclease exhibits both sequence-specific activity and non-sequence-specific activity; (ii) a second ribonucleoprotein (RNP2) complex comprising a second nucleic acid-guided nuclease and a second gRNA that is not complementary to the target nucleic acid of interest; wherein the second nucleic acid-guided nuclease exhibits both sequence-specific activity and non-sequence-specific activity; and (iii) a plurality of blocked nucleic acid molecules comprising a sequence complementary to the second gRNA, wherein the blocked nucleic acid molecules do not bind to the RNP1 complex or the RNP2 complex. In yet another fourth embodiment of the disclosure there is provided a reaction mixture comprising: (i) a first complex comprising a first nucleic acid-guided nuclease and a first guide RNA (gRNA); wherein the first gRNA comprises a sequence complementary to a target nucleic acid of interest, and wherein the first nucleic acid-guided nuclease exhibits both sequence-specific activity and non-sequence-specific activity; (ii) a second complex comprising a second nucleic acid-guided nuclease and a second gRNA that is not complementary to the target nucleic acid of interest; wherein the second nucleic acid-guided nuclease exhibits both sequence-specific activity and non-sequence-specific activity; and (iii) a plurality of blocked nucleic acid molecules comprising a sequence complementary to the second gRNA, wherein the blocked nucleic acid molecules are not recognized by the RNP1s or RNP2s.

A fifth embodiment provides a cascade assay method for detecting a target nucleic acid of interest in a sample comprising the steps of: (a) providing a reaction mixture comprising: (i) a first ribonucleoprotein (RNP) complex (RNP1) comprising a first nucleic acid-guided nuclease and a first guide RNA (gRNA); wherein the first gRNA comprises a sequence complementary to a target nucleic acid of interest, and wherein the first nucleic acid-guided nuclease exhibits both cis-cleavage activity and trans-cleavage activity; (ii) a second ribonucleoprotein complex (RNP2) comprising a second nucleic acid-guided nuclease and a second gRNA that is not complementary to the target nucleic acid of interest; wherein the second nucleic acid-guided nuclease exhibits both cis-cleavage activity and trans-cleavage activity; and (iii) a plurality of blocked nucleic acid molecules comprising a sequence complementary to the second gRNA, wherein the blocked nucleic acid molecules cannot activate the RNP1 or the RNP2; (b) contacting the reaction mixture with the sample under conditions that allow the target nucleic acid of interest in the sample to bind to RNP1; wherein upon binding of the target nucleic acid of interest RNP1 becomes active initiating trans-cleavage of at least one of the blocked nucleic acid molecules thereby producing at least one unblocked nucleic acid molecule and the at least one unblocked nucleic acid molecule binds to RNP2 initiating cleavage of at least one further blocked nucleic acid molecule; and (c) detecting products of the cleavage, thereby detecting the target nucleic acid of interest in the sample.

In a sixth embodiment there is provided a kit for detecting a target nucleic acid of interest in a sample comprising: (i) a first ribonucleoprotein (RNP1) complex (RNP1) comprising a first nucleic acid-guided nuclease and a first gRNA, wherein the first gRNA comprises a sequence complementary to the target nucleic acid of interest; and wherein binding of the RNP1 complex to the target nucleic acid of interest activates cis-cleavage and trans-cleavage activity of the first nucleic acid-guided nuclease; (ii) a second ribonucleoprotein complex (RNP2) comprising a second nucleic acid-guided nuclease and a second gRNA that is not complementary to the target nucleic acid of interest; a (iii) plurality of blocked nucleic acid molecules comprising a sequence corresponding to the second gRNA, wherein trans-cleavage activity of the blocked nucleic acid molecules results in at least one unblocked nucleic acid molecule; and wherein the unblocked nucleic acid molecule activates trans-cleavage activity of the second nucleic acid-guided nuclease in at least one RNP2 initiating cleavage of more blocked nucleic acid molecules; and (iv) a reporter moiety, wherein the reporter molecule comprises a nucleic acid molecule and/or is operably linked to the blocked nucleic acid molecule and produces a detectable signal upon trans-cleavage activity by the RNP1 or the RNP2, to identify the presence of the target nucleic acid of interest in the sample.

In some aspects of any one of the aforementioned embodiments, the first and/or second nucleic acid-guided nuclease is a Cas3, Cas12a, Cas12b, Cas12c, Cas12d, Cas12e, Cas14, Cas12h, Cas12i, Cas12j, Cas13a, Cas13b nuclease; in some aspects, the first nucleic acid-guided nuclease can is a different nucleic acid-guided nuclease than the second nucleic acid-guided nuclease; in some aspects, the first and/or second nucleic acid-guided nuclease is a Type V nucleic acid-guided nuclease or a Type VI nucleic acid-guided nuclease and/or in some aspects, the first and/or second nucleic acid-guided nuclease comprises a RuvC nuclease domain or a RuvC-like nuclease domain and lacks an HNH nuclease domain.

In some aspects of any one of the aforementioned embodiments, the blocked nucleic acid molecules comprise a structure represented by any one of Formulas I-IV, wherein Formulas I-IV comprise in the 5'-to-3' direction:

(a) A-(B-L)$_J$-C-M-T-D (Formula I);

wherein A is 0-15 nucleotides in length;
B is 4-12 nucleotides in length;
L is 3-25 nucleotides in length;
J is an integer between 1 and 10;
C is 4-15 nucleotides in length;
M is 1-25 nucleotides in length or is absent, wherein if M is absent then A-(B-L)$_J$-C and T-D are separate nucleic acid strands;
T is 17-135 nucleotides in length and comprises at least 50% sequence complementarity to B and C; and
D is 0-10 nucleotides in length and comprises at least 50% sequence complementarity to A;

(b) D-T-T'-C-(L-B)$_J$-A (Formula II);

wherein D is 0-10 nucleotides in length;
T-T' is 17-135 nucleotides in length;
T' is 1-10 nucleotides in length and does not hybridize with T;
C is 4-15 nucleotides in length and comprises at least 50% sequence complementarity to T;
L is 3-25 nucleotides in length and does not hybridize with T;
B is 4-12 nucleotides in length and comprises at least 50% sequence complementarity to T;
J is an integer between 1 and 10; A is 0-15 nucleotides in length and comprises at least 50% sequence complementarity to D;

(c) T-D-M-A-(B-L)$_J$-C (Formula III);

wherein T is 17-135 nucleotides in length;
D is 0-10 nucleotides in length;
M is 1-25 nucleotides in length or is absent, wherein if M is absent then T-D and A-(B-L)$_J$-C are separate nucleic acid strands;
A is 0-15 nucleotides in length and comprises at least 50% sequence complementarity to D;
B is 4-12 nucleotides in length and comprises at least 50% sequence complementarity to T;
L is 3-25 nucleotides in length;
J is an integer between 1 and 10; and
C is 4-15 nucleotides in length; or (d) T-D-M-A-L$_p$-C       (Formula IV);

wherein T is 17-31 nucleotides in length (e.g., 17-100, 17-50, or 17-25);
D is 0-15 nucleotides in length;
M is 1-25 nucleotides in length;
A is 0-15 nucleotides in length and comprises a sequence complementary to D; and
L is 3-25 nucleotides in length;
p is 0 or 1;
C is 4-15 nucleotides in length and comprises a sequence complementary to T.
And in some aspects,
(a) T of Formula I comprises at least 80% sequence complementarity to B and C;
(b) D of Formula I comprises at least 80% sequence complementarity to A;
(c) C of Formula II comprises at least 80% sequence complementarity to T;
(d) B of Formula II comprises at least 80% sequence complementarity to T;
(e) A of Formula II comprises at least 80% sequence complementarity to D;
(f) A of Formula III comprises at least 80% sequence complementarity to D;
(g) B of Formula III comprises at least 80% sequence complementarity to T;
(h) A of Formula IV comprises at least 80% sequence complementarity to D; and/or
(i) C of Formula IV comprises at least 80% sequence complementarity to T.

In aspects of the aforementioned embodiments, the blocked nucleic acid molecules comprise a first sequence complementary to the second gRNA and a second sequence not complementary to the second gRNA, wherein the second sequence at least partially hybridizes to the first sequence resulting in at least one loop.

In some aspects of the aforementioned embodiments, the reaction mixture comprises about 1 fM to about 10 μM of the RNP1 and in some aspects the reaction mixture comprises about 1 fM to about 1 mM of the RNP2.

In some aspects of the aforementioned embodiments, the reaction mixture comprises at least two different RNP1s, wherein different RNP1s comprise different gRNA sequences, and in some aspects the reaction mixture comprises 2 to 10000 different RNP1s, or 2 to 1000 different RNP1s, or 2 to 100 different RNP1s, or 2 to 10 different RNP1s.

In some aspects of the aforementioned embodiments, the blocked nucleic acid molecules include the sequence of any one of SEQ ID NOs: 14-1421.

In some aspects of the aforementioned embodiments, the blocked nucleic acid molecules are circular, and in some aspects the the blocked nucleic acid molecules are linear.

In some aspects the $K_d$ of the blocked nucleic acid molecules to the RNP2 is about $10^5$-fold greater, $10^6$-fold greater, $10^7$-fold greater, $10^8$-fold greater, $10^9$-fold greater, $10^{10}$-fold greater or more than the $K_d$ of unblocked nucleic acid molecules.

In some aspects of the aforementioned embodiments, the target nucleic acid of interest is of bacterial, viral, fungal, mammalian or plant origin, and in some aspects, the sample may include peripheral blood, serum, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, and umbilical cord blood; food; agricultural products; pharmaceuticals; cosmetics, nutriceuticals; personal care products; environmental substances such as soil, water, or air; industrial sites and products; or manufactured or natural chemicals and compounds.

In some aspects of the aforementioned embodiments, the reaction mixture further comprises a reporter moiety: wherein the reporter moiety comprises a DNA, RNA or chimeric nucleic acid molecule that is operably linked to the blocked nucleic acid molecule and produces a detectable signal upon cleavage by RNP1 and/or RNP2; or wherein the reporter moiety comprises a DNA, RNA or chimeric nucleic acid molecule and is not operably linked to the blocked nucleic acid molecule and produces a detectable signal upon cleavage by RNP1 and/or RNP2. In some aspects, the detectable signal is produced within about 1-10 minutes upon binding of the target nucleic acid of interest to RNP1; in some aspects, the detectable signal is a fluorescent, chemiluminescent, radioactive, colorimetric or optical signal; and/or in some aspects, the reporter moiety comprises a modified nucleoside or nucleotide including but not limited to locked nucleic acids (LNAs), peptide nucleic acids (PNAs), 2'-O-methyl (2'-O-Me) modified nucleosides, 2'-fluoro (2'-F) modified nucleoside, and/or a phosphorothioate (PS) bonds.

In some aspects of the aforementioned embodiments, the blocked nucleic acid molecules do not comprise a PAM sequence, yet in other aspects, the blocked nucleic acid molecules comprise a PAM sequence, and in some aspects the PAM sequence is disposed between the first and second sequences, wherein the first sequence is 5' to the PAM sequence.

In some aspects of the aforementioned embodiments, the blocked nucleic acid molecule is a blocked primer molecule.

In a seventh embodiment of the disclosure, there is provided a blocked nucleic acid molecule comprising: a first region recognized by a ribonucleoprotein (RNP) complex; one or more second regions not complementary to the first region; and one or more third regions complementary and hybridized to the first region, wherein cleavage of the one or more second regions results in dehybridization of the third region from the first region, resulting in an unblocked nucleic acid molecule.

An eighth embodiment provides a method of unblocking a blocked nucleic acid comprising: (a) providing a blocked nucleic acid molecule comprising: a first region recognized by a ribonucleoprotein (RNP) complex; one or more second regions not complementary to the first region; and one or more third regions complementary and hybridized to the first region, wherein cleavage of the one or more second regions results in dehybridization of the third region from the first region, resulting in an unblocked nucleic acid molecule; and (b) initiating cleavage of the one or more second regions, wherein the blocked nucleic acid molecule becomes an unblocked nucleic acid molecule.

A ninth embodiment provides a composition of matter comprising: a first region recognized by a ribonucleoprotein (RNP) complex; one or more second regions of not complementary to the first region; and one or more third regions complementary and hybridized to the first region, wherein cleavage of the one or more second regions results in dehybridization of the third region from the first region, resulting in an unblocked nucleic acid molecule; and the RNP complex comprising a gRNA that is complementary to the first region and a nucleic acid-guided nuclease, wherein the nucleic acid-guided nuclease exhibits both sequence-specific and non-sequence-specific nuclease activity.

Additionally, a tenth embodiment of the disclosure provides a cascade assay method of detecting a target nucleic acid of interest in a sample comprising the steps of: (a) providing a reaction mixture comprising: (i) a first ribonucleoprotein (RNP) complex (RNP1) comprising a first nucleic acid-guided nuclease and a first guide RNA (gRNA); wherein the first gRNA comprises a sequence complementary to a target nucleic acid of interest, and wherein the first nucleic acid-guided nuclease exhibits both cis-cleavage activity and trans-cleavage activity; (ii) a second ribonucleoprotein complex (RNP2) comprising a second nucleic acid-guided nuclease and a second gRNA that is not complementary to the target nucleic acid of interest; wherein the second nucleic acid-guided nuclease exhibits both cis-cleavage activity and trans-cleavage activity; and (iii) a plurality of linear blocked nucleic acid molecules comprising a sequence complementary to the second gRNA, wherein the linear blocked nucleic acid molecules cannot activate the RNP1 or the RNP2; (b) contacting the reaction mixture with the sample under conditions that allow the target nucleic acid of interest in the sample to bind to RNP1; wherein upon binding of the target nucleic acid of interest RNP1 becomes active initiating trans-cleavage of at least one of the linear blocked nucleic acid molecules thereby producing at least one linear unblocked nucleic acid molecule and the at least one linear unblocked nucleic acid molecule to RNP2 initiating cleavage of at least one further linear blocked nucleic acid molecule; and (c) detecting the cleavage products, thereby detecting the target nucleic acid of interest in the sample.

In some aspects of any one of the aforementioned embodiments, the first and/or second nucleic acid-guided nuclease is a Cas3, Cas12a, Cas12b, Cas12c, Cas12d, Cas12e, Cas14, Cas12h, Cas12i, Cas12j, Cas13a, Cas13b nuclease; in some aspects, the first nucleic acid-guided nuclease can is a different nucleic acid-guided nuclease than the second nucleic acid-guided nuclease; in some aspects, the first and/or second nucleic acid-guided nuclease is a Type V nucleic acid-guided nuclease or a Type VI nucleic acid-guided nuclease and/or in some aspects, the first and/or second nucleic acid-guided nuclease comprises a RuvC nuclease domain or a RuvC-like nuclease domain and lacks an HNH nuclease domain.

In some aspects, the blocked nucleic acid molecule comprises a structure represented by any one of Formulas I-IV, wherein Formulas I-IV are in the 5'-to-3' direction:

(a) A-(B-L)$_J$-C-M-T-D  (Formula I);

wherein A is 0-15 nucleotides in length;
B is 4-12 nucleotides in length;
L is 3-25 nucleotides in length;
J is an integer between 1 and 10;
C is 4-15 nucleotides in length;
M is 1-25 nucleotides in length or is absent, wherein if M is absent then A-(B-L)$_J$-C and T-D are separate nucleic acid strands;
T is 17-135 nucleotides in length and comprises at least 50% sequence complementarity to B and C; and
D is 0-10 nucleotides in length and comprises at least 50% sequence complementarity to A;

(b) D-T-T'-C-(L-B)$_J$-A  (Formula II);

wherein D is 0-10 nucleotides in length;
T-T' is 17-135 nucleotides in length;
T' is 1-10 nucleotides in length and does not hybridize with T;
C is 4-15 nucleotides in length and comprises at least 50% sequence complementarity to T;
L is 3-25 nucleotides in length and does not hybridize with T;
B is 4-12 nucleotides in length and comprises at least 50% sequence complementarity to T;
J is an integer between 1 and 10;
A is 0-15 nucleotides in length and comprises at least 50% sequence complementarity to D;

(c) T-D-M-A-(B-L)$_J$-C  (Formula III);

wherein T is 17-135 nucleotides in length;
D is 0-10 nucleotides in length;
M is 1-25 nucleotides in length or is absent, wherein if M is absent then T-D and A-(B-L)$_J$-C are separate nucleic acid strands;
A is 0-15 nucleotides in length and comprises at least 50% sequence complementarity to D;
B is 4-12 nucleotides in length and comprises at least 50% sequence complementarity to T;
L is 3-25 nucleotides in length;
J is an integer between 1 and 10; and
C is 4-15 nucleotides in length; or (d) T-D-M-A-L$_p$-C  (Formula IV);

wherein T is 17-31 nucleotides in length (e.g., 17-100, 17-50, or 17-25);
D is 0-15 nucleotides in length;
M is 1-25 nucleotides in length;
A is 0-15 nucleotides in length and comprises a sequence complementary to D; and
L is 3-25 nucleotides in length;
p is 0 or 1;
C is 4-15 nucleotides in length and comprises a sequence complementary to T.

Further
(a) T of Formula I comprises at least 80% sequence complementarity to B and C;
(b) D of Formula I comprises at least 80% sequence complementarity to A;
(c) C of Formula II comprises at least 80% sequence complementarity to T;
(d) B of Formula II comprises at least 80% sequence complementarity to T;
(e) A of Formula II comprises at least 80% sequence complementarity to D;
(f) A of Formula III comprises at least 80% sequence complementarity to D;
(g) B of Formula III comprises at least 80% sequence complementarity to T;

(h) A of Formula IV comprises at least 80% sequence complementarity to D; and/or
(i) C of Formula IV comprises at least 80% sequence complementarity to T.

In some aspects of the aforementioned embodiments, the blocked nucleic acid molecule comprises a modified nucleoside or nucleotide, including but not limited to a locked nucleic acid (LNA), peptide nucleic acid (PNA), 2'-O-methyl (2'-O-Me) modified nucleoside, 2'-fluoro (2'-F) modified nucleoside, and/or a phosphorothioate (PS) bond. In some aspects, the blocked nucleic acid molecule includes the sequence of any one of SEQ ID NOs: 14-1421; the blocked nucleic acid molecule is a blocked primer molecule; the blocked nucleic acid molecule does not comprise a PAM sequence; and/or in some aspects the blocked nucleic acid molecule comprises a PAM sequence, and the PAM sequence is disposed between the first and second sequences, wherein the first sequence is 5' to the PAM sequence.

In some aspects of the aforementioned embodiments, the reaction mixture further comprises a reporter moiety: wherein the reporter moiety comprises a DNA, RNA or chimeric nucleic acid molecule that is operably linked to the blocked nucleic acid molecule and produces a detectable signal upon cleavage by RNP1 and/or RNP2; or wherein the reporter moiety comprises a DNA, RNA or chimeric nucleic acid molecule and is not operably linked to the blocked nucleic acid molecule and produces a detectable signal upon cleavage by RNP1 and/or RNP2. In some aspects, the detectable signal is produced within about 1-10 minutes upon binding of the target nucleic acid of interest to RNP1; in some aspects, the detectable signal is a fluorescent, chemiluminescent, radioactive, colorimetric or optical signal; and/or in some aspects, the reporter moiety comprises a modified nucleoside or nucleotide including but not limited to locked nucleic acids (LNAs), peptide nucleic acids (PNAs), 2'-O-methyl (2'-O-Me) modified nucleosides, 2'-fluoro (2'-F) modified nucleosides, and/or a phosphorothioate (PS) bonds.

In some aspects, the $K_d$ of the blocked nucleic acid molecules to the RNP2 is about $10^5$-fold greater, $10^6$-fold greater, $10^7$-fold greater, $10^8$-fold greater, $10^9$-fold greater, $10^{10}$-fold greater or more than the $K_d$ of unblocked nucleic acid molecules.

In an eleventh embodiment, there is provided composition of matter comprising a ribonucleoprotein (RNP) complex and a blocked nucleic acid molecule, wherein the blocked nucleic acid molecule is represented by any one of Formula I-IV, wherein Formulas I-IV comprise in the 5'-to-3' direction comprises:

(a) A-(B-L)$_J$-C-M-T-D (Formula I);

wherein A is 0-15 nucleotides in length;
B is 4-12 nucleotides in length;
L is 3-25 nucleotides in length;
J is an integer between 1 and 10;
C is 4-15 nucleotides in length;
M is 1-25 nucleotides in length or is absent, wherein if M is absent then A-(B-L)$_J$-C and T-D are separate nucleic acid strands;
T is 17-135 nucleotides in length and comprises at least 50% sequence complementarity to B and C; and
D is 0-10 nucleotides in length and comprises at least 50% sequence complementarity to A;

(b) D-T-T'-C-(L-B)$_J$-A (Formula II);

wherein D is 0-10 nucleotides in length;
T-T' is 17-135 nucleotides in length;
T' is 1-10 nucleotides in length and does not hybridize with T;
C is 4-15 nucleotides in length and comprises at least 50% sequence complementarity to T;
L is 3-25 nucleotides in length and does not hybridize with T;
B is 4-12 nucleotides in length and comprises at least 50% sequence complementarity to T;
J is an integer between 1 and 10;
A is 0-15 nucleotides in length and comprises at least 50% sequence complementarity to D;

(c) T-D-M-A-(B-L)$_J$-C (Formula III);

wherein T is 17-135 nucleotides in length;
D is 0-10 nucleotides in length;
M is 1-25 nucleotides in length or is absent, wherein if M is absent then T-D and A-(B-L)$_J$-C are separate nucleic acid strands;
A is 0-15 nucleotides in length and comprises at least 50% sequence complementarity to D;
B is 4-12 nucleotides in length and comprises at least 50% sequence complementarity to T;
L is 3-25 nucleotides in length;
J is an integer between 1 and 10; and
C is 4-15 nucleotides in length; or (d) T-D-M-A-L$_p$-C (Formula IV);

wherein T is 17-31 nucleotides in length (e.g., 17-100, 17-50, or 17-25);
D is 0-15 nucleotides in length;
M is 1-25 nucleotides in length;
A is 0-15 nucleotides in length and comprises a sequence complementary to D; and
L is 3-25 nucleotides in length;
p is 0 or 1;
C is 4-15 nucleotides in length and comprises a sequence complementary to T.

In some aspects of this embodiment,
T of Formula I comprises at least 80% sequence complementarity to B and C;
(a) D of Formula I comprises at least 80% sequence complementarity to A;
(b) C of Formula II comprises at least 80% sequence complementarity to T;
(c) B of Formula II comprises at least 80% sequence complementarity to T;
(d) A of Formula II comprises at least 80% sequence complementarity to D;
(e) A of Formula III comprises at least 80% sequence complementarity to D;
(f) B of Formula III comprises at least 80% sequence complementarity to T;
(g) A of Formula IV comprises at least 80% sequence complementarity to D; and/or
(h) C of Formula IV comprises at least 80% sequence complementarity to T.

In some aspects of the aforementioned embodiment, the blocked primer molecules include the sequence of any one of SEQ ID NOs: 14-1421.

In some aspects of the aforementioned embodiment, the RNP complex comprises a Cas3, Cas12a, Cas12b, Cas12c, Cas12d, Cas12e, Cas14, Cas12h, Cas12i, Cas12j, Cas13a, Cas13b nuclease; in some aspects, the RNP complex comprises a Type V nucleic acid-guided nuclease or a Type VI nucleic acid-guided nuclease and/or in some aspects, the RNP complex comprises a RuvC nuclease domain or a RuvC-like nuclease domain and lacks an HNH nuclease domain.

In some aspects of the aforementioned embodiment, the blocked nucleic acid molecule comprises a modified nucleoside or nucleotide comprises a locked nucleic acid (LNA), peptide nucleic acid (PNA), 2'-O-methyl (2'-O-Me) modified nucleoside, 2'-fluoro (2'-F) modified nucleoside, and/or a phosphorothioate (PS) bond.

In some aspects, the blocked nucleic acid molecule does not comprise a PAM sequence, and in other aspects, the blocked nucleic acid molecule comprises a PAM sequence where the PAM sequence is disposed between the first and second sequences, wherein the first sequence is 5' to the PAM sequence. In some aspects, the blocked nucleic acid molecule is a blocked primer molecule.

In some aspects of the aforementioned embodiment(s), the composition of matter further comprises a reporter moiety: wherein the reporter moiety comprises a DNA, RNA or chimeric nucleic acid molecule that is operably linked to the blocked nucleic acid molecule and produces a detectable signal upon cleavage by RNP1 and/or RNP2; or wherein the reporter moiety comprises a DNA, RNA or chimeric nucleic acid molecule and is not operably linked to the blocked nucleic acid molecule and produces a detectable signal upon cleavage by RNP1 and/or RNP2. In some aspects, the detectable signal is produced within about 1-10 minutes upon binding of the target nucleic acid of interest to RNP1; in some aspects, the detectable signal is a fluorescent, chemiluminescent, radioactive, colorimetric or optical signal; and/or in some aspects, the reporter moiety comprises a modified nucleoside or nucleotide including but not limited to locked nucleic acids (LNAs), peptide nucleic acids (PNAs), 2'-O-methyl (2'-O-Me) modified nucleosides, 2'-fluoro (2'-F) modified nucleoside, and/or a phosphorothioate (PS) bonds.

Yet another embodiment provides a reaction mixture comprising: (i) a first ribonucleoprotein (RNP) complex (RNP1) comprising a first nucleic acid-guided nuclease and a first guide RNA (gRNA); wherein the first gRNA comprises a sequence complementary to a target nucleic acid of interest, and wherein the first nucleic acid-guided nuclease exhibits both cis-cleavage activity and trans-cleavage activity; (ii) a second ribonucleoprotein complex (RNP2) comprising a second nucleic acid-guided nuclease and a second gRNA that is not complementary to the target nucleic acid of interest; wherein the second nucleic acid-guided nuclease exhibits both cis-cleavage activity and trans-cleavage activity; (iii) a plurality of template molecules comprising a sequence corresponding to the second gRNA; (iv) a plurality of blocked primer molecules comprising a sequence complementary to the template molecules, wherein the blocked nucleic acid molecules cannot be extended by a polymerase; and (v) a polymerase and a plurality of nucleotides.

Another embodiment provides a cascade assay method for detecting a target nucleic acid of interest in a sample comprising: (a) providing a reaction mixture comprising: (i) a first ribonucleoprotein (RNP) complex (RNP1) comprising a first nucleic acid-guided nuclease and a first guide RNA (gRNA); wherein the first gRNA comprises a sequence complementary to a target nucleic acid of interest, and wherein the first nucleic acid-guided nuclease exhibits both cis-cleavage activity and trans-cleavage activity; (ii) a second ribonucleoprotein complex (RNP2) comprising a second nucleic acid-guided nuclease and a second gRNA that is not complementary to the target nucleic acid of interest; wherein the second nucleic acid-guided nuclease exhibits both cis-cleavage activity and trans-cleavage activity; (iii) a plurality of template molecules comprising a sequence corresponding to the second gRNA; (iv) a plurality of blocked primer molecules comprising a sequence complementary to the template molecules, wherein the blocked nucleic acid molecules cannot be extended by a polymerase; and (v) a polymerase and a plurality of nucleotides; (b) contacting the reaction mixture with the sample under conditions that allow target nucleic acids of interest in the sample to bind to the first gRNA, wherein: upon binding of the target nucleic acid of interest, the RNP1 active cleaving at least one of the blocked primer molecules, thereby producing at least one unblocked primer molecule that can be extended by the polymerase; at least one unblocked primer molecule binds to one of the template molecules and is extended by the polymerase and nucleotides to form at least one synthesized activating molecule having a sequence complementary to the second gRNA; at least one synthesized activating molecule binds to the second gRNA, and RNP2 becomes active cleaving at least one further blocked primer molecule; and detecting the cleavage products of step (b), thereby detecting the target nucleic acid of interest in the sample.

In some aspects the $K_d$ of the blocked nucleic acid molecules to the RNP2 is about $10^5$-fold greater, $10^6$-fold greater, $10^7$-fold greater, $10^8$-fold greater, $10^9$-fold greater, $10^{10}$-fold greater or more than the $K_d$ of unblocked nucleic acid molecules.

A further embodiment provides a kit for detecting a target nucleic acid of interest in a sample comprising: (i) a first ribonucleoprotein complex (RNP1) comprising a first nucleic acid-guided nuclease and a first gRNA, wherein the first gRNA comprises a sequence complementary to the target nucleic acid of interest; and wherein binding of the RNP1 complex to the target nucleic acid of interest activates cis-cleavage and trans-cleavage activity of the first nucleic acid-guided nuclease; (ii) a second ribonucleoprotein complex (RNP2) comprising a second nucleic acid-guided nuclease and a second gRNA that is not complementary to the target nucleic acid of interest; (iii) a plurality of template molecules comprising a non-target sequence to the second gRNA; (iv) a polymerase and nucleotides; (v) a plurality of blocked primer molecules comprising a sequence complementary to the template molecules, wherein the blocked primer molecule cannot be extended by the polymerase, trans-cleavage of the blocked primer molecules results in at least one unblocked primer molecule; and wherein the unblocked primer molecule can bind to at least one the template molecule and be extended by the polymerase to form a synthesized activating molecule; and (vi) a reporter moiety, wherein the reporter moiety comprises a nucleic acid molecule and/or is operably linked to the blocked primer molecule and produces a detectable signal upon trans-cleavage activity of the blocked primer molecule by the RNP1 or the RNP2, to identify the presence of the target nucleic acid of interest in the sample.

In any of these embodiments, the first and/or second nucleic acid-guided nuclease in the reaction mixture is a Cas3, Cas12a, Cas12b, Cas12c, Cas12d, Cas12e, Cas14, Cas12h, Cas12i, Cas12j, Cas13a, Cas13b nuclease; in some aspects, the first nucleic acid-guided nuclease is a different nucleic acid-guided nuclease than the second nucleic acid-guided nuclease; in some aspects the first and/or second nucleic acid-guided nuclease is a Type V nucleic acid-guided nuclease or a Type VI nucleic acid-guided nuclease; and in some aspects, the first and/or second nucleic acid-guided nuclease comprises a RuvC nuclease domain or a RuvC-like nuclease domain and lacks an HNH nuclease domain.

In some aspects the blocked primer molecules comprise a first sequence complementary to the second gRNA and a second sequence not complementary to the second gRNA, wherein the second sequence at least partially hybridizes to the first sequence resulting in at least one loop; and in some aspects, the blocked primer molecules comprise a structure represented by any one of Formulas I-IV, wherein Formulas I-IV are in the 5'-to-3' direction:

(a) A-(B-L)$_J$-C-M-T-D  (Formula I);

wherein A is 0-15 nucleotides in length;
B is 4-12 nucleotides in length;
L is 3-25 nucleotides in length;
J is an integer between 1 and 10;
C is 4-15 nucleotides in length;
M is 1-25 nucleotides in length or is absent, wherein if M is absent then A-(B-L)$_J$-C and T-D are separate nucleic acid strands;
T is 17-135 nucleotides in length and comprises at least 50% sequence complementarity to B and C; and
D is 0-10 nucleotides in length and comprises at least 50% sequence complementarity to A;

(b) D-T-T'-C-(L-B)$_J$-A  (Formula II);

wherein D is 0-10 nucleotides in length;
T-T' is 17-135 nucleotides in length;
T' is 1-10 nucleotides in length and does not hybridize with T;
C is 4-15 nucleotides in length and comprises at least 50% sequence complementarity to T;
L is 3-25 nucleotides in length and does not hybridize with T;
B is 4-12 nucleotides in length and comprises at least 50% sequence complementarity to T;
J is an integer between 1 and 10;
A is 0-15 nucleotides in length and comprises at least 50% sequence complementarity to D;

(c) T-D-M-A-(B-L)$_J$-C  (Formula III);

wherein T is 17-135 nucleotides in length;
D is 0-10 nucleotides in length;
M is 1-25 nucleotides in length or is absent, wherein if M is absent then T-D and A-(B-L)$_J$-C are separate nucleic acid strands;
A is 0-15 nucleotides in length and comprises at least 50% sequence complementarity to D;
B is 4-12 nucleotides in length and comprises at least 50% sequence complementarity to T;
L is 3-25 nucleotides in length;
J is an integer between 1 and 10; and
C is 4-15 nucleotides in length; or (d) T-D-M-A-L$_p$-C  (Formula IV);

wherein T is 17-31 nucleotides in length (e.g., 17-100, 17-50, or 17-25);
D is 0-15 nucleotides in length;
M is 1-25 nucleotides in length;
A is 0-15 nucleotides in length and comprises a sequence complementary to D; and
L is 3-25 nucleotides in length;
p is 0 or 1;
C is 4-15 nucleotides in length and comprises a sequence complementary to T.

In some aspects,
(a) T of Formula I comprises at least 80% sequence complementarity to B and C;
(b) D of Formula I comprises at least 80% sequence complementarity to A;
(c) C of Formula II comprises at least 80% sequence complementarity to T;
(d) B of Formula II comprises at least 80% sequence complementarity to T;
(e) A of Formula II comprises at least 80% sequence complementarity to D;
(f) A of Formula III comprises at least 80% sequence complementarity to D;
(g) B of Formula III comprises at least 80% sequence complementarity to T;
(h) A of Formula IV comprises at least 80% sequence complementarity to D; and/or
(i) C of Formula IV comprises at least 80% sequence complementarity to T.

In some aspects the reaction mixture comprises about 1 fM to about 10 µM of the RNP1, and in some aspects, the reaction mixture of claim 1, wherein the reaction mixture comprises about 1 fM to about 1 mM of the RNP2.

In some aspects of these embodiments, the reaction mixture comprises at least two different RNP1s, wherein different RNP1s comprise different gRNA sequences, and in some aspects, the reaction mixture comprises 2 to 10000 different RNP1s, 2 to 1000 different RNP1s, 2 to 100 different RNP1s, or 2 to 10 different RNP1s.

In some aspects the blocked primer molecules include the sequence of any one of SEQ ID NOs: 14-1421. In some aspects the K$_d$ of the blocked primer molecules to the RNP2 is about 10$^5$-fold greater, 10$^6$-fold greater, 10$^7$-fold greater, 10$^8$-fold greater, 10$^9$-fold greater, 10$^{10}$-fold greater or more than the K$_d$ of unblocked primer molecules.

In some aspects of the aforementioned embodiments, the reaction mixture further comprises a reporter moiety: wherein the reporter moiety comprises a DNA, RNA or chimeric nucleic acid molecule that is operably linked to the blocked nucleic acid molecule and produces a detectable signal upon cleavage by RNP1 and/or RNP2; or wherein the reporter moiety comprises a DNA, RNA or chimeric nucleic acid molecule and is not operably linked to the blocked nucleic acid molecule and produces a detectable signal upon cleavage by RNP1 and/or RNP2. In some aspects, the detectable signal is produced within about 1-10 minutes upon binding of the target nucleic acid of interest to RNP1; in some aspects, the detectable signal is a fluorescent, chemiluminescent, radioactive, colorimetric or optical signal; and/or in some aspects, the reporter moiety comprises a modified nucleoside or nucleotide including but not limited to locked nucleic acids (LNAs), peptide nucleic acids (PNAs), 2'-O-methyl (2'-O-Me) modified nucleosides, 2'-fluoro (2'-F) modified nucleoside, and/or a phosphorothioate (PS) bonds.

In some aspects of the aforementioned embodiments, the template molecules do not comprise a complement of a PAM sequence, and in some aspects, the template molecules comprise a complement of a PAM sequence. In some aspects, the template molecules are single-stranded. In some aspects, the template molecules are linear; in yet other aspects the template molecules are circularized. In some aspects comprising circular blocked nucleic acid molecules, at least one of the plurality of circular high Kd blocked nucleic acid molecules comprises a first region comprising a sequence specific to the second guide RNA and a second region comprising a nuclease-cleavable sequence; where at least one circular high Kd blocked nucleic acid molecule comprises a nuclease-resistant DNA sequence in the first region and a nuclease-cleavable DNA sequence in the second region; at least one circular high Kd blocked nucleic acid molecule comprises a nuclease-resistant RNA sequence in the first region and a nuclease-cleavable DNA and RNA sequence in the second region; at least one circular high Kd blocked nucleic acid molecule comprises a nuclease-resistant DNA sequence in the first region and a nuclease-cleavable DNA and RNA sequence in the second region; or at least one circular high Kd blocked nucleic acid molecule comprises a nuclease-resistant RNA sequence in the first region and a nuclease-cleavable RNA sequence in the second region.

In some aspects the polymerase comprises strand displacement activity and/or 3'-to-5' exonuclease activity, and in some aspects, the polymerase is Phi29 polymerase.

Yet another embodiment provides a composition of matter comprising a circular high Kd blocked nucleic acid molecule comprising: a region recognized by a gRNA in an RNP complex; a region comprising a sequence cleavable by a nucleic acid-guided nuclease in the RNP complex; and wherein the circular high Kd blocked nucleic acid molecule cannot activate the RNP complex, and wherein the circular high Kd blocked nucleic acid molecules are high Kd in relation to binding to the RNP complex.

A further embodiment provides a method of unblocking a circular high Kd blocked nucleic acid molecule comprising the steps of: (a) providing a circular high Kd blocked nucleic acid molecule comprising: a first region recognized by a gRNA in an RNP complex; a second region comprising a sequence cleavable by a nucleic acid-guided nuclease in the RNP complex, wherein the circular high Kd blocked nucleic acid molecule cannot substantially activate the RNP complex; and (b) initiating cleavage of the second region by the nucleic acid-guided nuclease in the RNP complex, wherein the circular high Kd blocked nucleic acid molecule becomes a linear low Kd unblocked nucleic acid molecule, and wherein the circular high Kd blocked nucleic acid molecules are high Kd and linear low $K_d$ unblocked nucleic acid molecules are high $K_d$ and low $K_d$ in relation to binding the RNP complex.

Also provided as an embodiment is a cascade assay method of detecting a target nucleic acid of interest in a sample comprising the steps of: (a) providing a reaction mixture comprising: (i) a first ribonucleoprotein (RNP) complex (RNP1) comprising a first nucleic acid-guided nuclease and a first guide RNA (gRNA); wherein the first gRNA comprises a sequence complementary to a target nucleic acid of interest; (ii) a second ribonucleoprotein (RNP2) complex comprising a second nucleic acid-guided nuclease and a second gRNA that is not complementary to the target nucleic acid molecule; and (iii) a plurality of circular blocked nucleic acid molecules comprising a sequence complementary to the second gRNA, wherein the circular blocked nucleic acid molecules cannot activate the RNP1 complex or the RNP2 complex; (b) contacting the reaction mixture with the sample under conditions that allow the target nucleic acid of interest in the sample to bind to RNP1; wherein upon binding of the target nucleic acid of interest, RNP1 becomes active initiating trans-cleavage of at least one of the circular blocked nucleic acid molecules thereby producing at least one linear unblocked nucleic acid molecule; the at least one linear unblocked nucleic acid molecule binds to RNP2 initiating cleavage of at least one further circular blocked nucleic acid molecule; and (c) detecting the cleavage products, thereby detecting the target nucleic acid of interest in the sample.

In some aspects, the RNP complex (either RNP1 or RNP2) comprises a nucleic acid-guided nuclease selected from Cas3, Cas12a, Cas12b, Cas12c, Cas12d, Cas12e, Cas14, Cas12h, Cas12i, Cas12j, Cas13a, or Cas13b, and in some aspects, the RNP complex comprises a nucleic acid-guided nuclease that is a Type V nucleic acid-guided nuclease or a Type VI nucleic acid-guided nuclease; the RNP complex comprises a nucleic acid-guided nuclease that exhibits both cis-cleavage and trans-cleavage activity; and/or the RNP complex comprises a nucleic acid-guided nuclease comprising a RuvC nuclease domain or a RuvC-like nuclease domain but lacks an HNH nuclease domain.

In some aspects of any embodiments comprising circular high $K_d$ blocked nucleic acid molecules, the circular high $K_d$ blocked nucleic acid molecule comprises a nuclease-resistant DNA sequence in the first region and a nuclease-cleavable DNA sequence in the second region; the circular high $K_d$ blocked nucleic acid molecule comprises a nuclease-resistant RNA sequence in the first region and a nuclease-cleavable DNA and RNA sequence in the second region; the circular high $K_d$ blocked nucleic acid molecule comprises a nuclease-resistant DNA sequence in the first region and a nuclease-cleavable DNA and RNA sequence in the second region; or the circular high $K_d$ blocked nucleic acid molecule comprises a nuclease-resistant RNA sequence in the first region and a nuclease-cleavable RNA sequence in the second region.

In some aspects of these embodiments, the circular high $K_d$ blocked nucleic acid molecule comprises 5' and 3' ends hybridized to each other and DNA, RNA, LNA or PNA bases having a high $T_m$; and in some aspects, the $K_d$ of the circular high $K_d$ blocked nucleic acid molecules to the RNP complex or RNP2 is about $10^5$-fold greater, $10^6$-fold greater, $10^7$-fold greater, $10^8$-fold greater, $10^9$-fold greater, $10^{10}$-fold greater or more than the $K_d$ of unblocked circular high $K_d$ blocked nucleic acid molecules.

In some aspects the circular high $K_d$ blocked nucleic acid molecule comprises a modified nucleoside or nucleotide, including but not limited to a locked nucleic acid (LNA), a peptide nucleic acid (PNA), a 2'-O-methyl (2'-O-Me) modified nucleoside, a 2'-fluoro (2'-F) modified nucleoside, and/or a phosphorothioate (PS) bond.

In some aspects the circular high $K_d$ blocked nucleic acid molecule is a single-stranded, double-stranded, or partially double-stranded molecule comprising one or more different combinations of DNA-DNA, DNA-RNA or RNA-RNA hybrid molecules. In some aspects the circular high $K_d$ blocked nucleic acid molecule is a circular high $K_d$ primer molecule. In some aspects the circular high $K_d$ blocked nucleic acid molecule does not comprise a PAM sequence or the circular high $K_d$ blocked nucleic acid molecule comprises a PAM sequence.

In some aspects of the aforementioned embodiments, the compositions of matter or reaction further comprises a reporter moiety wherein the reporter moiety comprises a DNA, RNA or chimeric nucleic acid molecule that is operably linked to the blocked nucleic acid molecule and produces a detectable signal upon cleavage by RNP1 and/or RNP2; or wherein the reporter moiety comprises a DNA, RNA or chimeric nucleic acid molecule and is not operably linked to the blocked nucleic acid molecule and produces a detectable signal upon cleavage by RNP1 and/or RNP2. In some aspects, the detectable signal is produced within about 1-10 minutes upon binding of the target nucleic acid of interest to RNP1; in some aspects, the detectable signal is a fluorescent, chemiluminescent, radioactive, colorimetric or optical signal; and/or in some aspects, the reporter moiety comprises a modified nucleoside or nucleotide including but not limited to locked nucleic acids (LNAs), peptide nucleic acids (PNAs), 2'-O-methyl (2'-O-Me) modified nucleosides, 2'-fluoro (2'-F) modified nucleoside, and/or a phosphorothioate (PS) bonds.

Yet another embodiment provides a composition of matter comprising: (a) a first preassembled ribonucleoprotein complex (RNP1) comprising a first nucleic acid-guided nuclease and a first guide RNA that is specific to a target nucleic acid of interest, wherein the first nucleic acid-guided nuclease exhibits cis-cleavage activity and trans-cleavage activity; (b) a second preassembled ribonucleoprotein complex (RNP2) comprising a second nucleic acid-guided nuclease and a second guide RNA, wherein the second nucleic acid-guided nuclease exhibits cis-cleavage activity and trans-cleavage activity; and (c) a plurality of circular high $K_d$ blocked nucleic acid molecules comprising a sequence complementary to the second gRNA, wherein the circular high $K_d$ blocked nucleic acid molecules are not recognized by the RNP1 or RNP2, and wherein the circular high $K_d$ blocked nucleic acid molecules are high $K_d$ in relation to binding to RNP2.

Another embodiment provides a composition of matter comprising: (a) a first preassembled ribonucleoprotein complex (RNP1) comprising a first nucleic acid-guided nuclease and a first guide RNA that is specific to a target nucleic acid of interest, wherein the first nucleic acid-guided nuclease exhibits cis-cleavage activity and trans-cleavage activity; (b) a second preassembled ribonucleoprotein complex (RNP2) comprising a second nucleic acid-guided nuclease and a second guide RNA, wherein the second nucleic acid-guided nuclease exhibits cis-cleavage activity and trans-cleavage activity; and (c) a plurality of engineered linear high $K_d$ blocked nucleic acid molecules comprising a first sequence complementary to the second gRNA, wherein the linear high $K_d$ blocked nucleic acid molecules are not recognized by the RNP1 and RNP2, and wherein the linear high $K_d$ blocked nucleic acid molecules are high $K_d$ in relation to binding to the RNP2.

Yet another embodiment provides a composition of matter comprising: (a) a first preassembled ribonucleoprotein complex (RNP1) comprising a first nucleic acid-guided nuclease and a first guide RNA that is specific to a target nucleic acid of interest, wherein the first nucleic acid-guided nuclease exhibits cis-cleavage activity and trans-cleavage activity; (b) a second preassembled ribonucleoprotein complex (RNP2) comprising a second nucleic acid-guided nuclease and a second guide RNA, wherein the second nucleic acid-guided nuclease exhibits cis-cleavage activity and trans-cleavage activity; and (c) a plurality of engineered high $K_d$ blocked nucleic acid molecules comprising a sequence complementary to the second gRNA, wherein the high $K_d$ blocked nucleic acid molecules are not recognized by the RNP1 and RNP2, and wherein the high $K_d$ blocked nucleic acid molecules are high $K_d$ in relation to binding to the RNP complex.

In aspects of any one of the foregoing embodiments, the high $K_d$ blocked nucleic acid molecule comprises DNA, RNA, LNA or PNA bases having a high Tm; the 5' and 3' ends of the high $K_d$ blocked nucleic acid molecule comprise phosphorothioate bonds (PS); high $K_d$ blocked nucleic acid molecule comprises one or more different combinations of DNA-DNA, DNA-RNA or RNA-RNA hybrid molecules; and/or the high $K_d$ blocked nucleic acid molecule comprises a nucleic acid region comprising nanoparticles attached thereto, wherein the nanoparticles provide steric hindrance to internalization in RNP2 and block RNP2 activation until cleavage and removal of the nucleic acid region comprising the nanoparticles.

In other aspects, the first and/or second nucleic acid-guided nuclease is a Cas3, Cas12a, Cas12b, Cas12c, Cas12d, Cas12e, Cas14, Cas12h, Cas12i, Cas12j, Cas13a, Cas13b nuclease; in some aspects, the first nucleic acid-guided nuclease can is a different nucleic acid-guided nuclease than the second nucleic acid-guided nuclease; in some aspects, the first and/or second nucleic acid-guided nuclease is a Type V nucleic acid-guided nuclease or a Type VI nucleic acid-guided nuclease and/or in some aspects, the first and/or second nucleic acid-guided nuclease comprises a RuvC nuclease domain or a RuvC-like nuclease domain and lacks an HNH nuclease domain.

Aspects also include the composition of matter comprises about 1 fM to about 10 μM of the RNP1; and/or the composition of matter comprises about 1 fM to about 1 mM of the RNP2.

In some aspects the composition of matter comprises at least two different RNP1 complex species, wherein different RNP1s comprise different gRNA sequences; and in some aspects the composition comprises 2 to 10000 different RNP1s, 2 to 1000 different RNP1s, 2 to 100 different RNP1s, or 2 to 10 different RNP1s.

In some aspects the RNP2 recognizes a PAM sequence, and in other aspects the RNP2 complex does not recognize a PAM sequence.

In some aspects of the aforementioned embodiments, the composition of matter further comprises a reporter moiety, wherein the reporter moiety comprises a DNA, RNA or chimeric nucleic acid molecule that is operably linked to the blocked nucleic acid molecule and produces a detectable signal upon cleavage by RNP1 and/or RNP2; or wherein the reporter moiety comprises a DNA, RNA or chimeric nucleic acid molecule and is not operably linked to the blocked nucleic acid molecule and produces a detectable signal upon cleavage by RNP1 and/or RNP2. In some aspects, the detectable signal is produced within about 1-10 minutes upon binding of the target nucleic acid of interest to RNP1; in some aspects, the detectable signal is a fluorescent, chemiluminescent, radioactive, colorimetric or optical signal; and/or in some aspects, the reporter moiety comprises a modified nucleoside or nucleotide including but not limited to locked nucleic acids (LNAs), peptide nucleic acids (PNAs), 2'-O-methyl (2'-O-Me) modified nucleosides, 2'-fluoro (2'-F) modified nucleoside, and/or a phosphorothioate (PS) bonds.

In some aspects the high $K_d$ blocked nucleic acid molecule is a high $K_d$ blocked primer molecule.

In some aspects the linear high $K_d$ blocked nucleic acid molecule is converted to a linear low $K_d$ blocked nucleic acid molecule upon trans-cleavage by RNP1 and/or RNP2. In some aspects the $K_d$ of the blocked nucleic acid molecules to the RNP2 is about $10^5$-fold greater, $10^6$-fold greater, $10^7$-fold greater, $10^8$-fold greater, $10^9$-fold greater, $10^{10}$-fold greater or more than the $K_d$ of unblocked nucleic acid molecules.

In some aspects of the compositions of matter comprising circular blocked nucleic acid molecules, at least one of the plurality of circular high Kd blocked nucleic acid molecules comprises a first region comprising a sequence specific to the second guide RNA and a second region comprising a nuclease-cleavable sequence; where at least one circular high Kd blocked nucleic acid molecule comprises a nuclease-resistant DNA sequence in the first region and a nuclease-cleavable DNA sequence in the second region; at least one circular high Kd blocked nucleic acid molecule comprises a nuclease-resistant RNA sequence in the first region and a nuclease-cleavable DNA and RNA sequence in the second region; at least one circular high Kd blocked nucleic acid molecule comprises a nuclease-resistant DNA sequence in the first region and a nuclease-cleavable DNA and RNA sequence in the second region; or at least one circular high Kd blocked nucleic acid molecule comprises a nuclease-resistant RNA sequence in the first region and a nuclease-cleavable RNA sequence in the second region.

In some aspects of the compositions of matter comprising linear blocked nucleic acid molecules, the linear high $K_d$ nucleic acid molecules comprise a structure represented by any one of Formulas I-IV, where Formulas I-IV comprise in the 5'-to-3' direction:

(a) A-(B-L)$_J$-C-M-T-D  (Formula I);

wherein A is 0-15 nucleotides in length;
B is 4-12 nucleotides in length;
L is 3-25 nucleotides in length;
J is an integer between 1 and 10;
C is 4-15 nucleotides in length;
M is 1-25 nucleotides in length or is absent, wherein if M is absent then A-(B-L)$_J$-C and T-D are separate nucleic acid strands;
T is 17-135 nucleotides in length and comprises at least 50% sequence complementarity to B and C; and
D is 0-10 nucleotides in length and comprises at least 50% sequence complementarity to A;

(b) D-T-T'-C-(L-B)$_J$-A  (Formula II)

wherein D is 0-10 nucleotides in length;
T-T' is 17-135 nucleotides in length;
T' is 1-10 nucleotides in length and does not hybridize with T;
C is 4-15 nucleotides in length and comprises at least 50% sequence complementarity to T;
L is 3-25 nucleotides in length and does not hybridize with T;
B is 4-12 nucleotides in length and comprises at least 50% sequence complementarity to T;
J is an integer between 1 and 10;
A is 0-15 nucleotides in length and comprises at least 50% sequence complementarity to D;

(c) T-D-M-A-(B-L)$_J$-C  (Formula III);

D is 0-10 nucleotides in length;
M is 1-25 nucleotides in length or is absent, wherein if M is absent then T-D and A-(B-L)$_J$-C are separate nucleic acid strands;
A is 0-15 nucleotides in length and comprises at least 50% sequence complementarity to D;
B is 4-12 nucleotides in length and comprises at least 50% sequence complementarity to T;
L is 3-25 nucleotides in length;
J is an integer between 1 and 10; and
C is 4-15 nucleotides in length; or (d) T-D-M-A-L$_p$-C  (Formula IV);

wherein T is 17-31 nucleotides in length (e.g., 17-100, 17-50, or 17-25);
D is 0-15 nucleotides in length;
M is 1-25 nucleotides in length;
A is 0-15 nucleotides in length and comprises a sequence complementary to D; and
L is 3-25 nucleotides in length;
p is 0 or 1;
C is 4-15 nucleotides in length and comprises a sequence complementary to T.

And in some aspects,
(a) T of Formula I comprises at least 80% sequence complementarity to B and C;
(b) D of Formula I comprises at least 80% sequence complementarity to A;
(c) C of Formula II comprises at least 80% sequence complementarity to T;
(d) B of Formula II comprises at least 80% sequence complementarity to T;
(e) A of Formula II comprises at least 80% sequence complementarity to D;
(f) A of Formula III comprises at least 80% sequence complementarity to D;
(g) B of Formula III comprises at least 80% sequence complementarity to T;
(h) A of Formula IV comprises at least 80% sequence complementarity to D; and/or
(i) C of Formula IV comprises at least 80% sequence complementarity to T.

In some aspects, at least one of the linear blocked nucleic acid molecules include the sequence of any one of SEQ ID NOs: 14-1421.

In another embodiment, there is provided a method for syndromic testing comprising: (a) providing a reaction mixture comprising: (i) a plurality of first ribonucleoprotein complexes (RNP1s), each RNP1 comprising a nucleic acid-guided nuclease exhibiting both cis-cleavage and trans-cleavage activity and a first guide RNA (gRNA), wherein the first gRNA comprises a sequence complementary to a target nucleic acid of interest, and wherein the reaction mixture comprises at least two different RNP1s, wherein different RNP1s comprise different first gRNAs; (ii) a second ribonucleoprotein complex (RNP2), wherein the RNP2 comprises a second nucleic acid-guided nuclease and a second gRNA that does not recognize any of the target nucleic acids of interest; and (iii) a plurality of blocked nucleic acid molecules comprising a sequence complementary to the second gRNA, wherein the blocked nucleic acid molecule cannot substantially activate the plurality of RNP1s or the RNP2; (b) contacting the reaction mixture with a sample under conditions that allow target nucleic acids of interest in the sample to bind to the RNP1s, wherein: upon binding of any one of the target nucleic acids of interest, the RNP1 becomes active, cleaving at least one of the blocked nucleic acid molecules, thereby producing at least one unblocked nucleic acid molecule; and at least one unblocked nucleic acid molecule binds to the second gRNA thereby activating RNP2 and initiating trans-cleavage of at least one further blocked nucleic acid molecule; and (c) detecting products of the cleavage of step (b), thus identifying at least one target nucleic acid of interest in the sample.

In some aspects of this embodiment, the first and/or second nucleic acid-guided nuclease is a Cas3, Cas12a, Cas12b, Cas12c, Cas12d, Cas12e, Cas14, Cas12h, Cas12i, Cas12j, Cas13a, Cas13b nuclease; in some aspects, the first nucleic acid-guided nuclease can is a different nucleic acid-guided nuclease than the second nucleic acid-guided nuclease; in some aspects, the first and/or second nucleic acid-guided nuclease is a Type V nucleic acid-guided nuclease or a Type VI nucleic acid-guided nuclease and/or in some aspects, the first and/or second nucleic acid-guided nuclease comprises a RuvC nuclease domain or a RuvC-like nuclease domain and lacks an HNH nuclease domain.

Aspects also include the reaction mixture comprises about 1 fM to about 10 μM of the RNP1; and/or the reaction mixture comprises about 1 fM to about 1 mM of the RNP2. In some aspects the reaction mixture comprises at least two different RNP1 complex species, wherein different RNP1s comprise different gRNA sequences; and in some aspects the composition comprises 2 to 10000 different RNP1s, 2 to 1000 different RNP1s, 2 to 100 different RNP1s, or 2 to 10 different RNP1s.

In some aspects the $K_d$ of the plurality of blocked nucleic acid molecules to the RNP2 is about $10^5$-fold greater, $10^6$-fold greater, $10^7$-fold greater, $10^8$-fold greater, $10^9$-fold greater, $10^{10}$-fold greater or more than the $K_d$ of unblocked nucleic acid molecules.

In some aspects of the aforementioned embodiment, the target nucleic acid of interest is of bacterial, viral, fungal, or mammalian origin, and in some aspects, the sample may include peripheral blood, serum, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, and/or umbilical cord blood.

In some aspects of the aforementioned embodiments, the reaction mixture further comprises a reporter moiety: wherein the reporter moiety comprises a DNA, RNA or chimeric nucleic acid molecule that is operably linked to the blocked nucleic acid molecule and produces a detectable signal upon cleavage by RNP1 and/or RNP2; or wherein the reporter moiety comprises a DNA, RNA or chimeric nucleic acid molecule and is not operably linked to the blocked nucleic acid molecule and produces a detectable signal upon cleavage by RNP1 and/or RNP2. In some aspects, the detectable signal is produced within about 1-10 minutes upon binding of the target nucleic acid of interest to RNP1; in some aspects, the detectable signal is a fluorescent, chemiluminescent, radioactive, colorimetric or optical signal; and/or in some aspects, the reporter moiety comprises a modified nucleoside or nucleotide including but not limited to locked nucleic acids (LNAs), peptide nucleic acids (PNAs), 2'-O-methyl (2'-O-Me) modified nucleosides, 2'-fluoro (2'-F) modified nucleoside, and/or a phosphorothioate (PS) bonds. In some aspects the detectable signal is produced within about 1-10 minutes upon the target nucleic acid of interest activating RNP1.

In some aspects the blocked nucleic acid molecules comprise a PAM sequence and in other aspects, the blocked nucleic acid molecules do not comprise a PAM sequence. In some aspects the blocked nucleic acid molecules are linear and in some aspects, the blocked nucleic acids are circular and in yet other aspects, the blocked nucleic acid molecules are a mixture of circular and linear blocked nucleic acid molecules.

In some aspects the blocked nucleic acid molecules are blocked primer molecules and wherein the reaction mixture further comprises a polymerase and nucleotides.

In some aspects, the syndromic testing is for any two or more of common flu (e.g., influenza A, influenza A/H1, influenza A/H3, influenza A/H1-2009, and influenza B); one of the multiple strains of respiratory syncytial virus (RSV), such as RSV-A and RSV-B; at least one variant of SARS-CoV-2 (e.g., B.1.1.7, B.1.351, P.1, B.1.617.2, BA.1, BA.2, BA.2.12.1, BA.4, and BA.5); and at least one of other pathogens of interest (e.g., parainfluenza virus 1-4, human metapneumovirus, human rhinovirus, human enterovirus, adenovirus, coronavirus HKU1, coronavirus NL63, coronavirus 229E, coronavirus OC43, MERS).

Yet other embodiments provide: a method of detecting a target nucleic acid of interest in a sample comprising the steps of: providing a reaction mixture comprising a first RNP complex comprising a first nucleic acid-guided nuclease and a first guide RNA (gRNA), wherein the first gRNA comprises a sequence complementary to a target nucleic acid of interest; and a second RNP complex comprising a second nucleic acid-guided nuclease and a second gRNA that is not complementary to the target nucleic acid of interest; and contacting the reaction mixture with the sample under conditions that allow the target nucleic acid of interest in the sample to bind to the first gRNA, wherein upon binding of the target nucleic acid of interest, the first RNP complex becomes active which catalyzes activation of the second RNP complex via one or more blocked nucleic acids to produce a detectable signal from a reporter moiety.

A further embodiment provides a modular cascade assay comprising: a first nucleic acid-guided nuclease, wherein the first nucleic acid-guided nuclease will form a first ribonucleoprotein complex with a first gRNA that is complementary to a target nucleic acid of interest; a second RNP2 complex comprising a second nucleic acid-guided nuclease and a second gRNA that is not complementary to a target nucleic acid of interest; and a plurality of blocked nucleic acid molecules comprising a sequence complementary to the second gRNA, wherein the blocked nucleic acid molecules cannot activate the RNP1 complex or the RNP2 complex; wherein by changing the sequence of the first gRNA, the modular cascade assay is changed to detect different target nucleic acids of interest.

These aspects and other features and advantages of the invention are described below in more detail.

BRIEF DESCRIPTION OF THE DRAWINGS

The foregoing and other features and advantages of the present invention will be more fully understood from the following detailed description of illustrative embodiments taken in conjunction with the accompanying drawings in which:

FIG. 4 illustrates three embodiments of reporter moieties.

FIG. 5A shows a lateral flow assay that can be used to detect the cleavage and separation of a signal from a reporter moiety.

FIG. 6 shows a titered quantification of a synthesized nucleocapsid gene (N-gene) using the nucleic acid detection methods described herein. As described in Example VI, a cascade assay was initiated using the detection methods described in Examples II-V above.

FIG. 7 shows titered quantification of an inactivated SARS-CoV-2 virus using the nucleic acid detection methods described in Examples II-V above.

FIG. 9 shows titered quantification of DNA from Methicillin-resistant *Staphylococcus* (MRSA) using the nucleic acid detection methods described in Examples II-V.

It should be understood that the drawings are not necessarily to scale, and that like reference numbers refer to like features.

Definitions

Figure 1A:
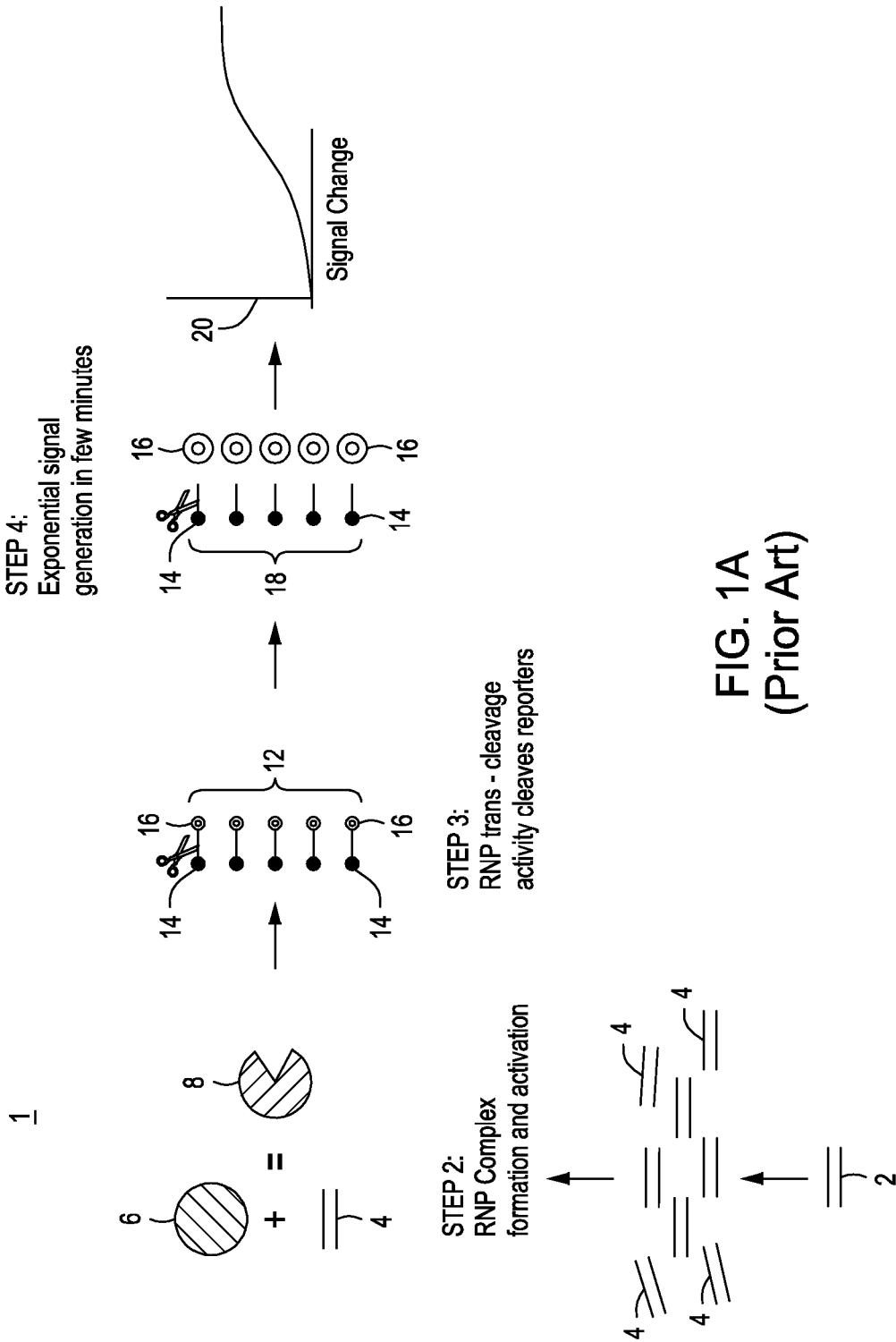
FIG. 1A is an overview of a prior art assay where target nucleic acids of interest from a sample must be amplified before performing a detection assay.

All of the functionalities described in connection with one embodiment of the compositions and methods described herein are intended to be applicable to the additional embodiments of the compositions and methods described herein except where expressly stated or where the feature or function is incompatible with the additional embodiments. For example, where a given feature or function is expressly described in connection with one embodiment but not expressly mentioned in connection with an alternative embodiment, it should be understood that the feature or function may be deployed, utilized, or implemented in connection with the alternative embodiment unless the feature or function is incompatible with the alternative embodiment.

Note that as used herein and in the appended claims, the singular forms "a," "an," and "the" include plural referents unless the context clearly dictates otherwise. Thus, for example, reference to "a cell" refers to one or more cells, and reference to "a system" includes reference to equivalent steps, methods and devices known to those skilled in the art, and so forth. Additionally, it is to be understood that terms such as "left," "right," "top," "bottom," "front," "rear," "side," "height," "length," "width," "upper," "lower," "interior," "exterior," "inner," "outer" that may be used herein merely describe points of reference and do not necessarily limit embodiments of the present disclosure to any particular orientation or configuration. Furthermore, terms such as "first," "second," "third," etc., merely identify one of a number of portions, components, steps, operations, functions, and/or points of reference as disclosed herein, and likewise do not necessarily limit embodiments of the present disclosure to any particular configuration or orientation.

Unless defined otherwise, all technical and scientific terms used herein have the same meaning as commonly understood by one of ordinary skill in the art to which this invention belongs. All publications mentioned herein are incorporated by reference for the purpose of describing and disclosing devices, formulations and methodologies that may be used in connection with the presently described invention. Conventional methods are used for the procedures described herein, such as those provided in the art, and demonstrated in the Examples and various general references. Unless otherwise stated, nucleic acid sequences described herein are given, when read from left to right, in the 5' to 3' direction. Nucleic acid sequences may be provided as DNA, as RNA, or a combination of DNA and RNA (e.g., a chimeric nucleic acid).

Where a range of values is provided, it is understood that each intervening value, between the upper and lower limit of that range and any other stated or intervening value in that stated range is encompassed within the invention. The upper and lower limits of these smaller ranges may independently be included in smaller ranges, and are also encompassed within the invention, subject to any specifically excluded limit in the stated range. Where the stated range includes one or both of the limits, ranges excluding either or both of those included limits are also included in the invention.

The term "and/or" where used herein is to be taken as specific disclosure of each of the multiple specified features or components with or without another. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following embodiments: A, B, and C; A, B, or C; A or C; A or B; B or C; A and C; A and B; B and C; A (alone); B (alone); and C (alone).

In the following description, numerous specific details are set forth to provide a more thorough understanding of the present invention. However, it will be apparent to one of skill in the art that the present invention may be practiced without one or more of these specific details. In other instances, features and procedures well known to those skilled in the art have not been described in order to avoid obscuring the invention. The terms used herein are intended to have the plain and ordinary meaning as understood by those of ordinary skill in the art.

As used herein, the term "about," as applied to one or more values of interest, refers to a value that falls within 10%, 9%, 8%, 7%, 6%, 5%, 4%, 3%, 2%, 1%, or less in either direction (greater than or less than) of a stated reference value, unless otherwise stated or otherwise evident from the context (except where such number would exceed 100% of a possible value).

As used herein, the terms "binding affinity" or "dissociation constant" or "$K_d$" refer to the tendency of a molecule to bind (covalently or non-covalently) to a different molecule. A high $K_d$ (which in the context of the present disclosure refers to blocked nucleic acid molecules or blocked primer molecules binding to RNP2) indicates the presence of more unbound molecules, and a low $K_d$ (which in the context of the present disclosure refers to unblocked nucleic acid molecules or unblocked primer molecules binding to RNP2) indicates the presence of more bound molecules. In the context of the present disclosure and the binding of blocked or unblocked nucleic acid molecules or blocked or unblocked primer molecules to RNP2, aow $K_d$ values are in a range from about 100 fM to about 1 aM or lower (e.g., 100 zM) and high $K_d$ values are in the range of 100 nM-100 μM (10 mM) and thus are about $10^5$- to $10^{10}$-fold or higher as compared to low $K_d$ values.

As used herein, the terms "binding domain" or "binding site" refer to a region on a protein, DNA, or RNA, to which specific molecules and/or ions (ligands) may form a covalent or non-covalent bond. By way of example, a polynucleotide sequence present on a nucleic acid molecule (e.g., a primer binding domain) may serve as a binding domain for a different nucleic acid molecule (e.g., an unblocked primer nucleic acid molecule). Characteristics of binding sites are chemical specificity, a measure of the types of ligands that will bond, and affinity, which is a measure of the strength of the chemical bond.

As used herein, the term "blocked nucleic acid molecule" refers to nucleic acid molecules that cannot bind to the first or second RNP complex to activate cis- or trans-cleavage. "Unblocked nucleic acid molecule" refers to a formerly blocked nucleic acid molecule that can bind to the second RNP complex (RNP2) to activate trans-cleavage of additional blocked nucleic acid molecules.

The terms "Cas RNA-guided endonuclease" or "CRISPR nuclease" or "nucleic acid-guided nuclease" refer to a CRISPR-associated protein that is an RNA-guided endonuclease suitable for assembly with a sequence-specific gRNA to form a ribonucleoprotein (RNP) complex.

As used herein, the terms "cis-cleavage", "cis-endonuclease activity", "cis-mediated endonuclease activity", "cis-nuclease activity", "cis-mediated nuclease activity", and variations thereof refer to sequence-specific cleavage of a target nucleic acid of interest, including an unblocked nucleic acid molecule or synthesized activating molecule, by a nucleic acid-guided nuclease in an RNP complex. Cis-cleavage is a single turn-over cleavage event in that only one substrate molecule is cleaved per event.

The term "complementary" as used herein refers to Watson-Crick base pairing between nucleotides and specifically refers to nucleotides hydrogen-bonded to one another with thymine or uracil residues linked to adenine residues by two hydrogen bonds and cytosine and guanine residues linked by three hydrogen bonds. In general, a nucleic acid includes a nucleotide sequence described as having a "percent complementarity" or "percent homology" to a specified second nucleotide sequence. For example, a nucleotide sequence may have 80%, 90%, or 100% complementarity to a specified second nucleotide sequence, indicating that 8 of 10, 9 of 10, or 10 of 10 nucleotides of a sequence are complementary to the specified second nucleotide sequence. For instance, the nucleotide sequence 3'-TCGA-5' is 100% complementary to the nucleotide sequence 5'-AGCT-3'; and the nucleotide sequence 3'-TCGATCGATCGA-5' [SEQ ID NO: 1] is 100% complementary to a region of the nucleotide sequence 5'-GCTAGCTAGC-3' [SEQ ID NO: 2].

As used herein, the term "contacting" refers to placement of two moieties in direct physical association, including in solid or liquid form. Contacting can occur in vitro with isolated cells (for example in a tissue culture dish or other vessel) or in vivo by administering an agent to a subject.

A "control" is a reference standard of a known value or range of values.

The terms "guide nucleic acid" or "guide RNA" or "gRNA" refer to a polynucleotide comprising 1) a crRNA region or guide sequence capable of hybridizing to the target strand of a target nucleic acid of interest, and 2) a scaffold sequence capable of interacting or complexing with a nucleic acid-guided nuclease. The crRNA region of the gRNA is a customizable component that enables specificity in every nucleic acid-guided nuclease reaction. A gRNA can include any polynucleotide sequence having sufficient complementarity with a target nucleic acid of interest to hybridize with the target nucleic acid of interest and to direct sequence-specific binding of a ribonucleoprotein (RNP) complex containing the gRNA and nucleic acid-guided nuclease to the target nucleic acid. Target nucleic acids of interest may include a protospacer adjacent motif (PAM), and, following gRNA binding, the nucleic acid-guided nuclease induces a double-stranded break either inside or outside the protospacer region on the target nucleic acid of interest, including on an unblocked nucleic acid molecule or synthesized activating molecule. A gRNA may contain a spacer sequence including a plurality of bases complementary to a protospacer sequence in the target nucleic acid. For example, a spacer can contain about 2, 3, 4, 5, 6, 7, 8, 9, 10, 11, 12, 13, 14, 15, 20, 25, 30, 35, 40, 45, 50, 55, 60, or more bases. The gRNA spacer may be 50%, 60%, 75%, 80%, 85%, 90%, 95%, 97.5%, 98%, 99%, or more complementary to its corresponding target nucleic acid of interest. Optimal alignment may be determined with the use of any suitable algorithm for aligning sequences. A guide RNA may be from about 20 nucleotides to about 300 nucleotides long. Guide RNAs may be produced synthetically or generated from a DNA template.

"Modified" refers to a changed state or structure of a molecule. Molecules may be modified in many ways including chemically, structurally, and functionally. In one embodiment, a nucleic acid molecule (for example, a blocked nucleic acid molecule) may be modified by the introduction of non-natural nucleosides, nucleotides, and/or internucleoside linkages. In another embodiment, a modified protein (e.g., a nucleic acid-guided nuclease) may refer to any polypeptide sequence alteration which is different from the wildtype.

The terms "percent sequence identity", "percent identity", or "sequence identity" refer to percent (%) sequence identity with respect to a reference polynucleotide or polypeptide sequence following alignment by standard techniques. Alignment for purposes of determining percent sequence identity can be achieved in various ways that are within the capabilities of one of skill in the art, for example, using publicly available computer software such as BLAST, BLAST-2, PSI-BLAST, or Megalign software. In some embodiments, the software is MUSCLE (Edgar, Nucleic Acids Res., 32(5):1792-1797 (2004)). Those skilled in the art can determine appropriate parameters for aligning sequences, including any algorithms needed to achieve maximal alignment over the full length of the sequences being compared. For example, in embodiments, percent sequence identity values are generated using the sequence comparison computer program BLAST (Altschul et al., J. Mol. Biol., 215:403-410 (1990)).

As used herein, the terms "preassembled ribonucleoprotein complex", "ribonucleoprotein complex", "RNP complex", or "RNP" refer to a complex containing a guide RNA (gRNA) and a nucleic acid-guided nuclease, where the gRNA is integrated with the nucleic acid-guided nuclease. The gRNA, which includes a sequence complementary to a target nucleic acid of interest, guides the RNP to the target nucleic acid of interest and hybridizes to it. The hybridized target nucleic acid-gRNA units are cleaved by the nucleic acid-guided nuclease. In the cascade assays described herein, a first ribonucleoprotein complex (RNP1) includes a first guide RNA (gRNA) specific to a nucleic acid target nucleic acid of interest, and a first nucleic acid-guided nuclease, such as, for example, cas12a or cas14a for a DNA target nucleic acid, or cas13a for an RNA target nucleic acid. A second ribonucleoprotein complex (RNP2) for signal amplification includes a second guide RNA specific to an unblocked nucleic acid or synthesized activating molecule, and a second nucleic acid-guided nuclease, which may be different from or the same as the first nucleic acid-guided nuclease.

As used herein, the terms "protein" and "polypeptide" are used interchangeably. Proteins may or may not be made up entirely of amino acids.

As used herein, the term "sample" refers to tissues; cells or component parts; body fluids, including but not limited to peripheral blood, serum, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, and umbilical cord blood; food; agricultural products; pharmaceuticals; cosmetics, nutriceuticals; personal care products; environmental substances such as soil, water, or air; industrial sites and products; and chemicals and compounds. A sample further may include a homogenate, lysate or extract. A sample further refers to a medium, such as a nutrient broth or gel, which may contain cellular components, such as proteins or nucleic acid molecules.

The terms "target DNA sequence", "target sequence", "target nucleic acid of interest", "target molecule of interest", "target nucleic acid", or "target of interest" refer to any locus that is recognized by a gRNA sequence in vitro or in vivo. The "target strand" of a target nucleic acid of interest is the strand of the double-stranded target nucleic acid that is complementary to a gRNA. The spacer sequence of a gRNA may be 50%, 60%, 75%, 80%, 85%, 90%, 95%, 97.5%, 98%, 99% or more complementary to the target nucleic acid of interest. Optimal alignment can be determined with the use of any suitable algorithm for aligning sequences. Full complementarity is not necessarily required provided there is sufficient complementarity to cause hybridization and trans-cleavage activation of an RNP complex. A target nucleic acid of interest can include any polynucleotide, such as DNA (ssDNA or dsDNA) or RNA polynucleotides. A target nucleic acid of interest may be located in the nucleus or cytoplasm of a cell such as, for example, within an organelle of a eukaryotic cell, such as a mitochondrion or a chloroplast, or it can be exogenous to a host cell, such as a eukaryotic cell or a prokaryotic cell. The target nucleic acid of interest may be present in a sample, such as a biological or environmental sample, and it can be a viral nucleic acid molecule, a bacterial nucleic acid molecule, a fungal nucleic acid molecule, or a polynucleotide of another organism, such as a coding or a non-coding sequence, and it may include single-stranded or double-stranded DNA molecules, such as a cDNA or genomic DNA, or RNA molecules, such as mRNA, tRNA, and rRNA. The target nucleic acid may be associated with a protospacer adjacent motif (PAM) sequence, which may include a 2-5 base pair sequence adjacent to the protospacer. In some embodiments 1, 2, 3, 4, 5, 6, 7, 8, 9, 10, or more target nucleic acids can be detected by the disclosed method.

As used herein, the terms "trans-cleavage", "trans-endonuclease activity", "trans-mediated endonuclease activity", "trans-nuclease activity", "trans-mediated nuclease activity", and variations thereof, refer to indiscriminate, non-sequence-specific cleavage of a nucleic acid molecule by an endonuclease (such as by a Cas12, Cas13, and Cas14) which is triggered by cis-(sequence-specific) cleavage. Trans-cleavage is a "multiple turn-over" event, in that more than one substrate molecule is cleaved after initiation by a single turn-over cis-cleavage event.

Type V CRISPR/Cas nucleic acid-guided nucleases are a subtype of Class 2 CRISPR/Cas effector nucleases such as, but not limited to, engineered Cas12a, Cas12b, Cas12c, C2c4, C2c8, C2c5, C2c10, C2c9, CasX (Cas12e), CasY (Cas12d), Cas 13a nucleases or naturally-occurring proteins, such as a Cas12a isolated from, for example, *Francisella tularensis* subsp. *novicida* (Gene ID: 60806594), *Candidatus Methanoplasma termitum* (Gene ID: 24818655), *Candidatus Methanomethylophilus alvus* (Gene ID: 15139718), and [*Eubacterium*] *eligens* ATCC 27750 (Gene ID: 41356122), and an artificial polypeptide, such as a chimeric protein.

The term "variant" refers to a polypeptide or polynucleotide that differs from a reference polypeptide or polynucleotide but retains essential properties. A typical variant of a polypeptide differs in amino acid sequence from another reference polypeptide. Generally, differences are limited so that the sequences of the reference polypeptide and the variant are closely similar overall and, in many if not most regions, identical. A variant and reference polypeptide may differ in amino acid sequence by one or more modifications (e.g., substitutions, additions, and/or deletions). A variant of a polypeptide may be a conservatively modified variant. A substituted or inserted amino acid residue may or may not be one encoded by the genetic code (e.g., a non-natural amino acid). A variant of a polypeptide may be naturally occurring, such as an allelic variant, or it may be a variant that is not known to occur naturally. Variants include modifications—including chemical modifications—to one or more amino acids that do not involve amino acid substitutions, additions or deletions.

A "vector" is any of a variety of nucleic acids that comprise a desired sequence or sequences to be delivered to and/or expressed in a cell. Vectors are typically composed of DNA, although RNA vectors are also available. Vectors include, but are not limited to, plasmids, fosmids, phagemids, virus genomes, synthetic chromosomes, and the like.

DETAILED DESCRIPTION

The present disclosure provides compositions of matter, methods, and cascade assays for detecting nucleic acids. The cascade assays described herein comprise first and second ribonucleoprotein complexes and either blocked nucleic acid molecules or blocked primer molecules. The blocked nucleic acid molecules or blocked primer molecules keep the second ribonucleoprotein complexes "locked" unless and until a target nucleic acid of interest activates the first ribonucleoprotein complex. The methods comprise the steps of providing cascade assay components, contacting the cascade assay components with a sample, and detecting a signal that is generated only when a target nucleic acid of interest is present in the sample ids.

Early and accurate detection and determination of infections and diseases is crucial for appropriate prevention strategies, accurate testing, confirmation, and further diagnosis and treatment. Nucleic acid-guided nucleases, such as the Cas12a endonuclease, can be utilized as diagnostic tools for the detection of target nucleic acids of interest associated with diseases. However, currently available state-of-the-art CRISPR Cas12a-based nucleic acid detection relies on DNA amplification before using Cas12a enzymes, which significantly hinders the ability to perform rapid point-of-care testing. The lack of rapidity is due to the fact that target-specific activation of Cas12a enzymes, referred herein as cis-cleavage, is a single turnover event in which the number of activated enzyme complexes is, at most, equal to the number of copies of the target nucleic acids of interest in the sample. Once a ribonucleoprotein (RNP) complex is activated after completion of cis-cleavage, the RNP complex initiates rapid non-specific trans-endonuclease activity, which is a multi-turnover event. Some currently available methods use trans-cleavage to cleave fluorescent reporters that are initially quenched to generate a signal, thereby indicating the presence of a cis-cleavage event—the target nucleic acid. However, the $K_{cat}$ of activated Cas12a complex is 17/sec and 3/sec for dsDNA and ssDNA targets, respectively. Therefore, for less than 10,000 target copies, the number of reporters cleaved is not sufficient to generate a signal in less than 60 minutes. Hence, all current technologies rely on DNA amplification to first generate billions of target copies to activate a proportional number of ribonucleoprotein complexes to generate a detectable signal in 30-60 minutes.

The present disclosure describes a nucleic acid-guided nuclease cascade assay that can detect one or more target nucleic acids of interest (e.g., DNA, RNA and/or cDNA) at attamolar (aM) (or lower) limits in about 10 minutes or less without the need for amplifying the target nucleic acid(s) of interest, thereby avoiding the drawbacks of multiplex amplification, such as primer-dimerization. As described in detail below, the nucleic acid-guided nuclease cascade assays utilize signal amplification mechanisms comprising various components including nucleic acid-guided nucleases, guide RNAs (gRNAs), blocked nucleic acid molecules or blocked primer molecules, reporter moieties, and, in some embodiments, polymerases. A particularly advantageous feature of the cascade assay is that, with the exception of the gRNA (gRNA1) in RNP1, the cascade assay components stay the same no matter what target nucleic acid(s) of interest are being detected. In this sense, the cascade assay is modular.

FIG. 1A provides a simplified diagram demonstrating a prior art method (1) of a nucleic acid-guided nuclease detection assay where target nucleic acids of interest from a sample must be amplified in order to be detected. First, assuming the presence of a target nucleic acid of interest in a sample, the target nucleic acid of interest (2) is amplified to produce many copies of the target nucleic acid of interest (4). The detection assay is initiated (step 2) when the target nucleic acid of interest (4) is combined with and binds to a pre-assembled ribonucleoprotein complex (6), which is part of a reaction mix. The ribonucleoprotein complex (6) comprises a guide RNA (gRNA) and a nucleic acid-guided nuclease, where the gRNA is integrated with the nucleic acid-guided nuclease. The gRNA, which includes a sequence complementary to the target nucleic acid of interest, guides the RNP complex to the target nucleic acid of interest and hybridizes to it thereby activating the ribonucleoprotein complex (6). The nucleic acid-guided nuclease exhibits (i.e., possesses) both cis- and trans-cleavage activity, where trans-cleavage activity is initiated by cis-cleavage activity. Cis-cleavage activity occurs as the target nucleic acid of interest binds to the gRNA and is cleaved by the nucleic acid guided nuclease (i.e., activation). Once cis-cleavage of the target nucleic acid of interest is initiated, trans-cleavage activity is triggered, where trans-cleavage activity is indiscriminate, non-sequence-specific cleavage of nucleic acid molecules in the sample and is a multi-turnover event.

In step 3, the trans-cleavage activity triggers activation of reporter moieties (12) that are present in the reaction mix. The reporter moieties (12) may be a synthetic molecule linked or conjugated to a quencher (14) and a fluorophore (16) such as, for example, a probe with a dye label (e.g., FAM or FITC) on the 5' end and a quencher on the 3' end. The quencher (14) and fluorophore (16) typically are about 20-30 bases apart or less for effective quenching via fluorescence resonance energy transfer (FRET). Reporter moieties (12) are described in greater detail below. As more activated ribonucleoprotein complexes (6) are activated (6→8), more trans-cleavage activity of the nucleic acid-guided nuclease in the ribonucleoprotein complex is activated and more reporter moieties are activated (where here, "activated" means unquenched); thus, the binding of the target nucleic acid of interest (4).

As noted above, the downside to the prior art, currently available state-of-the-art nucleic acid-guided nuclease detection assays is that these detection assays rely on DNA amplification, which, in addition to issues with multiplexing, significantly hinders the ability to perform rapid point-of-care testing. The lack of rapidity is due to cis-cleavage of a target nucleic acid of interest being a single turnover event in which the number of activated enzyme complexes is, at most, equal to the number of copies of the target nucleic acids of interest in the sample. Once the ribonucleoprotein complex is activated after completion of cis-cleavage, trans-cleavage activity of the reporter moieties that are initially quenched is generated. However, the $K_{cat}$ of, e.g., activated Cas12a complex is 17/sec and 3/sec for dsDNA and ssDNA targets, respectively. Therefore, for less than 10,000 target copies, the number of reporters cleaved is not sufficient to generate a signal in less than 30-60 minutes.

Figure 1B:
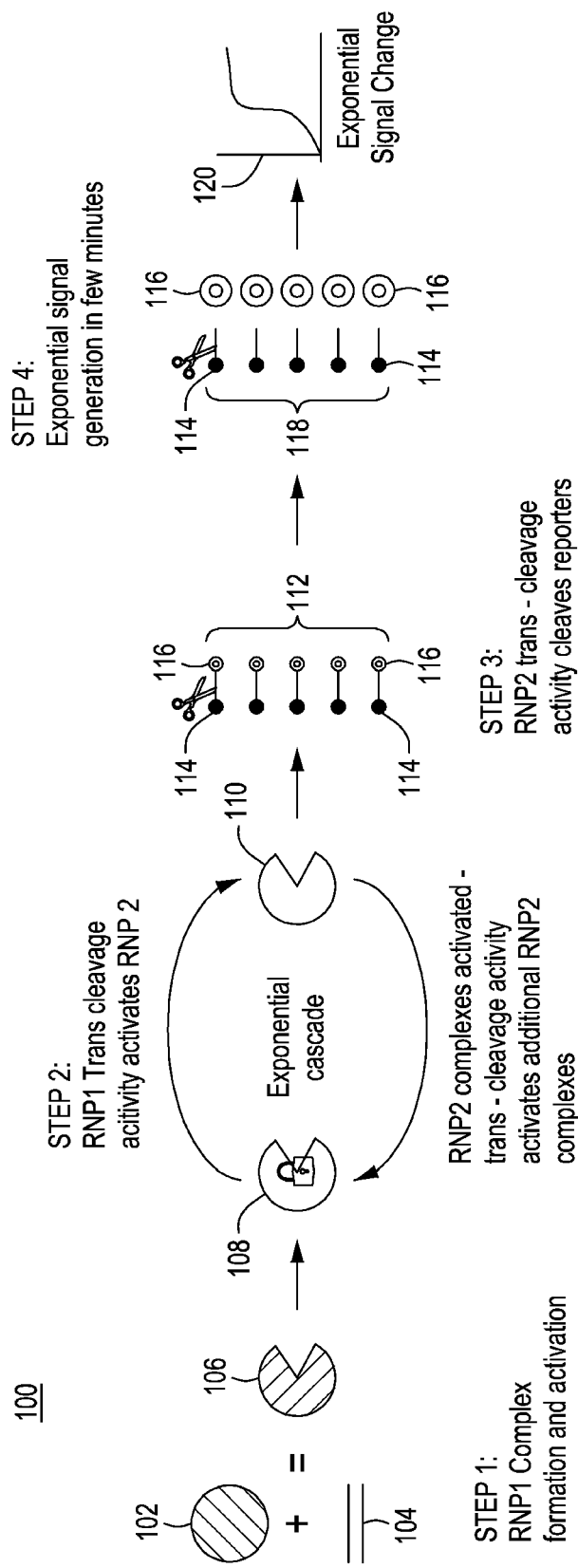
FIG. 1B is an overview of the general principles underlying the nucleic acid-guided nuclease cascade assay described in detail herein where target nucleic acids of interest from a sample do not need to be amplified before detection.

FIG. 1B provides a simplified diagram demonstrating a method (100) of a nucleic acid-guided nuclease cascade assay. The cascade assay is initiated when the target nucleic acid of interest (104) binds to and activates a first pre-assembled ribonucleoprotein complex (RNP1) (102). A ribonucleoprotein complex comprises a guide RNA (gRNA) and a nucleic acid-guided nuclease, where the gRNA is integrated with the nucleic acid-guided nuclease. The gRNA, which includes a sequence complementary to the target nucleic acid of interest, guides an RNP complex to the target nucleic acid of interest and hybridizes to it. Typically, preassembled RNP complexes are employed in the reaction mix—as opposed to separate nucleic acid-guided nucleases and gRNAs—to facilitate rapid detection of the target nucleic acid(s) of interest.

"Activation" of RNP1 refers to activating trans-cleavage activity of the nucleic acid-guided nuclease in RNP1 (106) by first initiating cis-cleavage where the target nucleic acid of interest is cut by the nucleic acid-guided nuclease. The cis-cleavage activity initiates trans-cleavage activity (i.e., multi-turnover activity) of the nucleic acid-guided nuclease, where trans-cleavage is indiscriminate, non-sequence-specific cutting of nucleic acid molecules by the nucleic acid-guided nuclease of RNP1 (102). This trans-cleavage activity triggers activation of blocked ribonucleoprotein complexes (RNP2s) (108) in various ways, which are described in detail below. Each newly activated RNP2 (110) activates more RNP2 (108→110), which in turn cleave reporter moieties (112). The reporter moieties (112) may be a synthetic molecule linked or conjugated to a quencher (114) and a fluorophore (116) such as, for example, a probe with a dye label (e.g., FAM or FITC) on the 5' end and a quencher on the 3' end. The quencher (114) and fluorophore (116) can be about 20-30 bases apart or less for effective quenching via fluorescence resonance energy transfer (FRET). Reporter moieties also are described in greater detail below. As more RNP2s are activated (108→110), more trans-cleavage activity is activated and more reporter moieties are activated (where here, "activated" means unquenched); thus, the binding of the target nucleic acid of interest (104) to RNP1 (102) initiates what becomes a cascade of signal production (120), which increases exponentially. The cascade assay thus comprises a single turnover event that triggers a multi-turnover event that then triggers another multi-turnover event. As described below in relation to FIG. 4, the reporter moieties (112) may be provided as molecules that are separate from the other components of the nucleic acid-guided nuclease cascade assay, or the reporter moieties may be covalently or non-covalently linked to the blocked nucleic acid molecules or synthesized activating molecules (i.e., the target molecules for the RNP2). The various components common to the embodiments of the cascade assay and methods described herein are described below.

Target Nucleic Acids of Interest

The target nucleic acid of interest may be a DNA, RNA, or cDNA molecule. Target nucleic acids of interest may be isolated from a sample or organism by standard laboratory techniques or may be synthesized by standard laboratory techniques (e.g., RT-PCR). In some embodiments, the target nucleic acids of interest are identified in a sample, such as a biological sample from a subject or an environmental sample (e.g., water or soil). Non-limiting examples of biological samples include blood, serum, plasma, saliva, mucus, a nasal swab, a buccal swab, a cell, a cell culture, and tissue. The source of the sample could be any mammal, such as, but not limited to, a human, primate, monkey, cat, dog, mouse, pig, cow, horse, sheep, and bat. Samples may also be obtained from any other source, such as air, water, soil, surfaces, food, beverages, nutraceuticals, clinical sites or products, industrial sites and products, cosmetics, personal care products, pharmaceuticals, medical devices, agricultural equipment and sites, and commercial samples.

In some embodiments, the target nucleic acid of interest is from an infectious agent (e.g., a bacteria, protozoan, insect, worm, virus, or fungus). As a non-limiting example, the target nucleic acid of interest could be one or more nucleic acid molecules from bacteria, such as *Bordetella parapertussis, Bordetella pertussis, Chlamydia pneumoniae, Legionella pneumophila, Mycoplasma pneumoniae, Acinetobacter calcoaceticus-baumannii* complex, *Bacteroides fragilis, Enterobacter cloacae* complex, *Escherichia coli, Klebsiella aerogenes, Klebsiella oxytoca, Klebsiella pneumoniae* group, *Moraxella catarrhalis, Proteus* spp., *Salmonella enterica, Serratia marcescens, Haemophilus influenzae, Neisseria meningitidis, Pseudomonas aeruginosa, Stenotrophomonas maltophilia, Enterococcus faecalis, Enterococcus faecium, Listeria monocytogenes, Staphylococcus aureus, Staphylococcus epidermidis, Staphylococcus lugdunensis, Streptococcus agalactiae, Streptococcus pneumoniae, Streptococcus pyogenes, Chlamydia trachomatis, Neisseria gonorrhoeae*, Syphilis (*Treponema pallidum*), *Ureaplasma urealyticum, Mycoplasma genitalium*, and/or *Gardnerella vaginalis*. As a non-limiting example, the target nucleic acid of interest could be one or more nucleic acid molecules from a virus, such as adenovirus, coronavirus HKU1, coronavirus NL63, coronavirus 229E, coronavirus OC43, severe acute respiratory syndrome coronavirus 2 (SARS-CoV-2), human metapneumovirus, human rhinovirus, enterovirus, influenza A, influenza A/H1, influenza A/H3, influenza A/H1-2009, influenza B, parainfluenza virus 1, parainfluenza virus 2, parainfluenza virus 3, parainfluenza virus 4, respiratory syncytial virus, herpes simplex virus 1, herpes simplex virus 2, human immunodeficiency virus (HIV), human papillomavirus, hepatitis A virus (HAV), hepatitis B virus (HBV), hepatitis C virus (HCV), and/or human parvovirus B19 (B19V). Also, as a non-limiting example, the target nucleic acid of interest could be one or more nucleic acid molecules from a fungus, such as *Candida albicans, Candida auris, Candida glabrata, Candida krusei, Candida parapsilosis, Candida tropicalis, Cryptococcus neoformans*, and/or *Cryptococcus gattii*. As another non-limiting example, the target nucleic acid of interest could be one or more nucleic acid molecules from a protozoan, such as *Trichomonas vaginalis*. In some embodiments, other target nucleic acids of interest may be for non-infectious conditions, e.g., to be used for genotyping. Other target nucleic acids of interest and samples are described herein.

The cascade assays described herein are particularly well-suited for syndromic testing. Syndromic testing allows simultaneous testing for multiple causative agents that cause similar symptoms. Syndromic testing allows rapid triage of patients, such as those needing emergency care, those amenable to treatment with pharmaceutical agents, those needing to be quarantined, etc. In syndrome testing, multiple target nucleic acids of interest are pooled into a single reaction, and this process may be repeated in multiple, separate reactions. A positive result in one of the reactions indicates that one of the target nucleic acids of interest in that pool is present. Pools of two to 10,000 target nucleic acids of interest may be employed, e.g., 2-1000, 2-100, 2-50, or 2-10. Further testing may be used to identify the specific member of the pool, if warranted. Syndromic testing allows the rapid triage of patients with the ability to focus further care rapidly.

While the methods described herein do not require the target nucleic acid of interest to be DNA (and in fact it is specifically contemplated that the target nucleic acid of interest may be RNA), it is understood by those in the field that a reverse transcription step to convert target RNA to cDNA may be performed prior to or while contacting the biological sample with the composition.

Nucleic Acid-Guided Nucleases

The cascade assays comprise nucleic acid-guided nucleases in the reaction mix, either provided as a protein, a coding sequence for the protein, or in a ribonucleoprotein (RNP) complex. In some embodiments, the one or more nucleic acid-guided nucleases in the reaction mix may be, for example, a Cas endonuclease. Any nucleic acid-guided nuclease having both cis- and trans-endonuclease activity may be employed, and the same nucleic acid-guided nuclease may be used for both RNPs or different nucleic acid-guided nucleases may be used in RNP1 and RNP2. Note that trans-cleavage activity is not triggered unless and until cis-cleavage activity (i.e., sequence specific activity) is initiated. Nucleic acid-guided nucleases include Type V and Type VI nucleic acid-guided nucleases, as well as nucleic acid-guided nucleases that comprise a RuvC nuclease domain or a RuvC-like nuclease domain but lack an HNH nuclease domain. Nucleic acid-guided nucleases with these properties are reviewed in Makarova and Koonin, Methods Mol. Biol., 1311:47-75 (2015) and Koonin, et al., Current Opinion in Microbiology, 37:67-78 (2020) and updated databases of nucleic acid-guided nucleases and nuclease systems that include newly-discovered systems include BioGRID ORCS (orcs:thebiogrid.org); GenomeCRISPR (genomecrispr.org); Plant Genome Editing Database (plantcrispr.org) and CRISPRCasFinder (crispercas.i2bc.paris-saclay.fr).

The type of nucleic acid-guided nuclease utilized in the method of detection depends on the type of target nucleic acid of interest to be detected. For example, a DNA nucleic acid-guided nuclease (e.g., a Cas12a, Cas14a, or Cas3) should be utilized if the target nucleic acid of interest is a DNA molecule, and an RNA nucleic acid-guided nuclease (e.g., Cas13a or Cas12g) should be utilized if the target nucleic acid of interest is an RNA molecule. Exemplary nucleic acid-guided nucleases include, but are not limited to, Cas RNA-guided DNA endonucleases, such as Cas3, Cas12a (e.g., AsCas12a, LbCas12a), Cas12b, Cas12c, Cas12d, Cas12e, Cas14, Cas12h, Cas12i, and Cas12j; Cas RNA-guided RNA endonucleases, such as Cas13a (LbaCas13, LbuCas13, LwaCas13), Cas13b (e.g., CccaCas13b, PsmCas13b), and Cas12g; and any other nucleic acid (DNA, RNA, or cDNA) targeting nucleic acid-guided nuclease with cis-cleavage activity and collateral trans-cleavage activity. In some embodiments, the nucleic acid-guided nuclease is a Type V CRISPR-Cas nuclease, such as a Cas12a, Cas13a, or Cas14a. In some embodiments, the nucleic acid-guided nuclease is a Type I CRISPR-Cas nuclease, such as Cas3. Type II and Type VI nucleic acid-guided nucleases may also be employed.

Guide RNA (gRNA)

The present disclosure detects a target nucleic acid of interest via a reaction mixture containing at least two gRNAs. Suitable guide RNAs include at least one crRNA region to enable specificity in every reaction. The gRNA of RNP1 is specific to a target nucleic acid of interest, and the gRNA of RNP2 is specific to an unblocked nucleic acid or a synthesized activating molecule (both described in detail herein). As will be clear given the description below, an advantageous feature of the cascade assay is that, with the exception of the gRNA in the RNP1 (i.e., the gRNA specific to the target nucleic acid of interest), the cascade assay components can stay the same no matter what target nucleic acid(s) of interest are being detected. In this sense, the cascade assay is modular.

Like the nucleic acid-guided nuclease, the gRNA may be provided in the cascade assay reaction mix in a preassembled RNP, as an RNA molecule, or may also be provided as a DNA sequence to be transcribed, in, e.g., a vector backbone. If provided as a gRNA molecule, the gRNA sequence may include multiple endoribonuclease recognition sites (e.g., Csy4) for multiplex processing. Alternatively, if provided as a DNA sequence to be transcribed, an endoribonuclease recognition site is encoded between neighboring gRNA sequences and more than one gRNA can be transcribed in a single expression cassette. Direct repeats can also serve as endoribonuclease recognition sites for multiplex processing. Guide RNAs are generally about 20 nucleotides to about 300 nucleotides in length and may contain a spacer sequence containing a plurality of bases and complementary to a protospacer sequence in the target sequence. The gRNA spacer sequence may be 50%, 60%, 75%, 80%, 85%, 90%, 95%, 97.5%, 98%, 99%, or more complementary to its intended target nucleic acid of interest.

The gRNA of RNP1 is capable of complexing with the nucleic acid-guided nuclease to perform cis-cleavage of a target nucleic acid of interest (e.g., a DNA or RNA), which triggers non-sequence specific trans-cleavage of other molecules in the reaction mix. Guide RNAs include any polynucleotide sequence having sufficient complementarity with a target nucleic acid of interest (or target sequences generated by unblocking blocked nucleic acid molecules or target sequences generated by synthesizing activating molecules as described below). Target sequences may include a protospacer-adjacent motif (PAM), and, following gRNA binding, the nucleic acid-guided nuclease induces a double-stranded break either inside or outside the protospacer region of the target sequence.

In some embodiments, the gRNA (e.g., of RNP1) is an exo-resistant circular molecule that can include several DNA bases between the 5' end and the 3' end of a natural guide RNA and is capable of binding a target sequence. The length of the circularized guide for RNP1 can be such that the circular form of guide can be complexed with a nucleic acid-guided nuclease to form a modified RNP1 which can still retain its cis-cleavage (specific) and trans-cleavage (non-specific) nuclease activity.

In any of the foregoing embodiments, the gRNA may be a modified or non-naturally occurring nucleic acid molecule. In some embodiments, the gRNAs of the disclosure may further contain a locked nucleic acid (LNA), a bridged nucleic acid (BNA), and/or a peptide nucleic acid (PNA). By way of further example, a modified nucleic acid molecule may contain a modified or non-naturally occurring nucleoside, nucleotide, and/or internucleoside linkage, such as a 2'-O-methyl (2'-O-Me) modified nucleoside, a 2'-fluoro (2'-F) modified nucleoside, and a phosphorothioate (PS) bond, or any other nucleic acid molecule modifications described herein.

Ribonucleoprotein (RNP) Complex

As described above, although the assay "reaction mix" may comprise separate nucleic acid-guided nucleases and gRNAs (or coding sequences therefor), the cascade assays preferably comprise preassembled ribonucleoprotein complexes (RNPs) in the reaction mix, allowing for faster detection kinetics. The present cascade assay employs at least two types of RNP complexes, RNP1 and RNP2, each type containing a nucleic acid-guided nuclease and a gRNA. RNP1 and RNP2 may comprise the same nucleic acid-guided nuclease or may comprise different nucleic acid-guided nucleases; however, the gRNAs in RNP1 and RNP2 are different and are configured to detect different nucleic acids. In some embodiments, the reaction mixture contains about 1 fM to about 10 µM of a given RNP1, or about 1 pM to about 1 µM of a given RNP1, or about 10 pM to about 500 pM of a given RNP1. In some embodiments the reaction mixture contains about $6 \times 10^4$ to about $6 \times 10^{12}$ complexes per microliter (µ) of a given RNP1, or about $6 \times 10^6$ to about $6 \times 10^{10}$ complexes per microliter (µ) of a given RNP1. In some embodiments, the reaction mixture contains about 1 fM to about 1 mM of a given RNP2, or about 1 pM to about 500 µM of a given RNP2, or about 10 pM to about 100 µM of a given RNP2. In some embodiments the reaction mixture contains about $6 \times 10^4$ to about $6 \times 10^{14}$ complexes per microliter (µ) of a given RNP2 or about $6 \times 10^6$ to about $6 \times 10^{12}$ complexes per microliter (µ) of a given RNP2. (See Example II below describing preassembling RNPs and Examples V-IX below describing various cascade assay conditions, including performing the cascade assay at room temperature.)

In any of the embodiments of the disclosure, the reaction mixture includes 1 to about 1,000 different RNP1s (e.g., 1, 2, 3, 4, 5, 6, 7, 8, 9, 10, 11, 12, 13, 14, 15, 16, 27, 28, 19, 20, 21, 22, 23, 24, 25, 50, 75, 100, 125, 150, 175, 200, 250, 300, 350, 400, 450, 500, 550, 600, 650, 700, 750, 800, 850, 900, 950, or 1,0000 RNP1s), where different RNP1s comprise a different gRNA (or crRNA thereof) polynucleotide sequence. For example, a reaction mixture designed for syndromic testing by definition comprises more than one unique RNP1-gRNA (or RNP1-crRNA) ribonucleoprotein complex for the purpose of detecting more than one target nucleic acid of interest. More than one RNP1 may also be present for the purpose of targeting more than one target nucleic acid of interest from a single organism or condition.

In any of the foregoing embodiments, the gRNA of RNP1 may be homologous or heterologous, relative to the gRNA of other RNP1 present in the reaction mixture. A homologous mixture of RNP1 gRNAs has a number of gRNAs with the same nucleotide sequence, whereas a heterologous mixture of RNP1 gRNAs has multiple gRNAs with different nucleotide sequences (e.g., gRNAs targeting different loci, genes, variants, and/or microbial species). Therefore, the disclosed methods of identifying one or more target nucleic acids of interest may include a reaction mixture containing more than two heterologous gRNAs, more than three heterologous gRNAs, more than four heterologous gRNAs, more than five heterologous gRNAs, more than six heterologous gRNAs, more than seven heterologous gRNAs, more than eight heterologous gRNAs, more than nine heterologous gRNAs, more than ten heterologous gRNAs, more than eleven heterologous gRNAs, more than twelve heterologous gRNAs, more than thirteen heterologous gRNAs, more than fourteen heterologous gRNAs, more than fifteen heterologous gRNAs, more than sixteen heterologous gRNAs, more than seventeen heterologous gRNAs, more than eighteen heterologous gRNAs, more than nineteen heterologous gRNAs, more than twenty heterologous gRNAs, more than twenty-one heterologous gRNAs, more than twenty-three heterologous gRNAs, more than twenty-four heterologous gRNAs, or more than twenty-five heterologous gRNAs. Such a heterologous mixture of RNP1 gRNAs in a single reaction enables the capability of syndromic testing.

As a first non-limiting example of a heterologous mixture of RNP1 gRNAs, the reaction mixture may contain: a number of RNP1s having a gRNA targeting parainfluenza virus 1; a number of RNP1s having a gRNA targeting human metapneumovirus; a number of RNP1s having a gRNA targeting human rhinovirus; a number of RNP1s having a gRNA targeting human enterovirus; and a number of RNP1s having a gRNA targeting coronavirus HKU1. As a second non-limiting example of a heterologous mixture of RNP1 gRNAs, the reaction mixture may contain: a number of RNP1s containing a gRNA targeting two or more SARS-Co-V-2 variants, e.g., B.1.1.7, B.1.351, P.1, B.1.617.2, BA.1, BA.2, BA.2.12.1, BA.4, and BA.5 and subvariants thereof.

Reporter Moieties

The cascade assay detects a target nucleic acid of interest via detection of a signal generated in the reaction mix by a reporter moiety. In some embodiments the detection of the target nucleic acid of interest occurs in about 10 minutes or less (e.g., 10, 9, 8, 7, 6, 5, 4, 3, 2, or 1 minute or less; e.g., FIGS. 6-9, and in some embodiments the detection of the target nucleic acid molecule is in about 5 minutes or less (e.g., 5, 4, 3, 2, or 1 minute or less; e.g., FIGS. 10-14). In some embodiments, the detection of the target nucleic acid molecule is in about 1 minute (e.g., FIGS. 10-13).

Depending on the type of reporter moiety used, trans- and/or cis-cleavage by the nucleic acid-guided nuclease in RNP2 releases a signal. In some embodiments, trans-cleavage of stand-alone (e.g., not bound to any blocked nucleic acid molecules) reporter moieties may generate signal changes at rates that are proportional to the cleavage rate, as new RNP2s are activated over time (shown in FIG. 1B and at top of FIG. 4). Trans-cleavage by either an activated RNP1 or an activated RNP2 may release a signal. In alternative embodiments, the reporter moiety may be bound to the blocked nucleic acid molecule, where trans-cleavage of the blocked nucleic acid molecule and conversion to an unblocked nucleic acid molecule may generate signal changes at rates that are proportional to the cleavage rate, as new RNP2s are activated over time, thus allowing for real time reporting of results (shown at FIG. 4, center). In yet another embodiment, the reporter moiety may be bound to a blocked nucleic acid molecule such that cis-cleavage following the binding of the RNP2 to an unblocked nucleic acid molecule releases a PAM distal sequence, which in turn generates a signal at rates that are proportional to the cleavage rate (shown at FIG. 4, bottom). In this case, activation of RNP2 by cis-(target specific) cleavage of the unblocked nucleic acid molecule directly produces a signal, rather than producing a signal via indiscriminate trans-cleavage activity. Alternatively. or in addition, the reporter moiety may be bound to the gRNA.

The reporter moiety may be a synthetic molecule linked or conjugated to a reporter and quencher such as, for example, a TaqMan probe with a dye label (e.g., FAM or FITC) on the 5' end and a quencher on the 3' end. The reporter and quencher may be about 20-30 bases apart or less for effective quenching via fluorescence resonance energy transfer (FRET). Alternatively, signal generation may occur through different mechanisms. Other detectable moieties, labels, or reporters can also be used to detect a target nucleic acid of interest as described herein. Reporter moieties can be labeled in a variety of ways, including direct or indirect attachment of a detectable moiety such as a fluorescent moiety, hapten, or colorimetric moiety. Examples of detectable moieties include various radioactive moieties, enzymes, prosthetic groups, fluorescent markers, luminescent markers, bioluminescent markers, metal particles, and protein-protein binding pairs, e.g., protein-antibody binding pairs. Examples of fluorescent moieties include, but are not limited to, yellow fluorescent protein (YFP), green fluorescence protein (GFP), cyan fluorescence protein (CFP), umbelliferone, fluorescein, fluorescein isothiocyanate, rhodamine, dichlorotriazinylamine fluorescein, cyanines, dansyl chloride, phycocyanin, and phycoerythrin. Examples of bioluminescent markers include, but are not limited to, luciferase (e.g., bacterial, firefly, click beetle and the like), luciferin, and aequorin. Examples of enzyme systems having visually detectable signals include, but are not limited to, galactosidases, glucorinidases, phosphatases, peroxidases, and cholinesterases. Identifiable markers also include radioactive elements such as $^{125}$I, $^{35}$S, $^{14}$C, or $^{3}$H.

The methods used to detect the generated signal will depend on the reporter moiety or moieties used. For example, a radioactive label can be detected using a scintillation counter, photographic film as in autoradiography, or storage phosphor imaging. Fluorescent labels can be detected by exciting the fluorochrome with the appropriate wavelength of light and detecting the resulting fluorescence. The fluorescence can be detected visually, by means of photographic film, by the use of electronic detectors such as charge coupled devices (CCDs) or photomultipliers and the like. Enzymatic labels can be detected by providing the appropriate substrates for the enzyme and detecting the resulting reaction product. Simple colorimetric labels can be detected by observing the color associated with the label. When pairs of fluorophores are used in an assay, fluorophores are chosen that have distinct emission patterns (wavelengths) so that they can be easily distinguished. In some embodiments, the signal can be detected by lateral flow assays (LFAs). Lateral flow tests are simple devices intended to detect the presence or absence of a target nucleic acid of interest in a sample. LFAs can use nucleic acid molecules conjugated nanoparticles (often gold, e.g., RNA-AuNPs or DNA-AuNPs) as a detection probe, which hybridizes to a complementary target sequence. (See FIGS. 5A and 5B and the description thereof below.) The classic example of an LFA is the home pregnancy test.

Single-stranded nucleic acid reporter moieties such as ssDNA reporter moieties or RNA molecules can be introduced to show a signal change proportional to the cleavage rate, which increases with every new activated RNP2 complex over time. In some embodiments and as described in detail below, single-stranded nucleic acid reporter moieties can also be embedded into the blocked nucleic acid molecules for real time reporting of results.

For example, the method of detecting a target nucleic acid molecule in a sample using a cascade assay as described herein can involve contacting the reaction mix with a labeled detection ssDNA containing a fluorescent resonance energy transfer (FRET) pair, a quencher/phosphor pair, or both. A FRET pair consists of a donor chromophore and an acceptor chromophore, where the acceptor chromophore may be a quencher molecule. FRET pairs (donor/acceptor) suitable for use include, but are not limited to, EDANS/fluorescein, IAEDANS/fluorescein, fluorescein/tetramethylrhodamine, fluorescein/Cy 5, IEDANS/DABCYL, fluorescein/QSY-7, fluorescein/LC Red 640, fluorescein/Cy 5.5, Texas Red/DABCYL, BODIPY/DABCYL, Lucifer yellow/DABCYL, coumarin/DABCYL, and fluorescein/LC Red 705. In addition, a fluorophore/quantum dot donor/acceptor pair can be used. EDANS is (5-((2-Aminoethyl)amino)naphthalene-1-sulfonic acid); IAEDANS is 5-({2-[(iodoacetyl)amino] ethyl}amino)naphthalene-1-sulfonic acid); DABCYL is 4-(4-dimethylaminophenyl) diazenylbenzoic acid. Useful quenchers include, but are not limited to, DABCYL, QSY 7 and QSY 33.

In any of the foregoing embodiments, the reporter moiety may comprise one or more modified nucleic acid molecules, containing a modified nucleoside or nucleotide. In some embodiments the modified nucleoside or nucleotide is chosen from 2'-O-methyl (2'-O-Me) modified nucleoside, a 2'-fluoro (2'-F) modified nucleoside, and a phosphorothioate (PS) bond, or any other nucleic acid molecule modifications described below.

Nucleic Acid Modifications

For any of the nucleic acid molecules described herein (e.g., blocked nucleic acid molecules, blocked primer molecules, gRNAs, template molecules, synthesized activating molecules, and reporter moieties), the nucleic acid molecules may be used in a wholly or partially modified form. Typically, modifications to the blocked nucleic acids, gRNAs, template molecules, reporter moieties, and blocked primer molecules described herein are introduced to optimize the molecule's biophysical properties (e.g., increasing endonuclease resistance and/or increasing thermal stability). Modifications typically are achieved by the incorporation of, for example, one or more alternative nucleosides, alternative sugar moieties, and/or alternative internucleoside linkages.

For example, one or more of the cascade assay components may include one or more of the following nucleoside modifications: 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl ($—C≡C—CH_3$) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine, and/or 3-deazaguanine and 3-deazaadenine. The nucleic acid molecules described herein (e.g., blocked nucleic acid molecules, blocked primer molecules, gRNAs, reporter molecules, synthesized activating molecules, and template molecules) may also include nucleobases in which the purine or pyrimidine base is replaced with other heterocycles, for example 7-deaza-adenine, 7-deazaguanosine, 2-aminopyridine, and/or 2-pyridone. Further modification of the nucleic acid molecules described herein may include nucleobases disclosed in U.S. Pat. No. 3,687,808; Kroschwitz, ed. The Concise Encyclopedia of Polymer Science and Engineering, New York, John Wiley & Sons, 1990, pp. 858-859; Englisch, et al., Angewandte Chemie, 30:613 (1991); and Sanghvi, Chapter 16, Antisense Research and Applications, CRC Press, Gait, ed., 1993, pp. 289-302.

In addition to or as an alternative to nucleoside modifications, the cascade assay components may comprise 2' sugar modifications, including 2'-O-methyl (2'-O-Me), 2'-methoxyethoxy (2'-O—$CH_2CH_2OCH_3$, also known as 2'-O-(2-methoxyethyl) or 2'-MOE), 2'-dimethylaminooxyethoxy, i.e., a $O(CH_2)_2ON(CH_3)_2$ group, also known as 2'-DMAOE, and/or 2'-dimethylaminoethoxyethoxy (also known in the art as 2'-O-dimethylamino-ethoxy-ethyl or 2'-DMAEOE), i.e., 2'-O—$CH_2OCH_2N(CH_3)_2$. Other possible 2'-modifications that can modify the nucleic acid molecules described herein (i.e., blocked nucleic acids, gRNAs, synthesized activating molecules, reporter molecules, and blocked primer molecules) may include all possible orientations of OH; F; O-, S-, or N-alkyl (mono- or di-); O-, S-, or N-alkenyl (mono- or di-); O-, S- or N-alkynyl (mono- or di-); or O-alkyl-O-alkyl, wherein the alkyl, alkenyl and alkynyl may be substituted or unsubstituted C1 to C10 alkyl or C2 to C10 alkenyl and alkynyl. Other potential sugar substituent groups include, e.g., aminopropoxy ($—OCH_2CH_2CH_2NH_2$), allyl ($—CH_2—CH=CH_2$), $—O-$allyl ($—O—CH_2—CH=CH_2$) and fluoro (F). 2'-sugar substituent groups may be in the arabino (up) position or ribo (down) position. In some embodiments, the 2'-arabino modification is 2'-F. Similar modifications may also be made at other positions on the interfering RNA molecule, particularly the 3' position of the sugar on the 3' terminal nucleoside or in 2'-5' linked oligonucleotides and the 5' position of 5' terminal nucleotide. Oligonucleotides may also have sugar mimetics such as cyclobutyl moieties in place of the pentofuranosyl sugar.

Finally, modifications to the cascade assay components may comprise internucleoside modifications such as phosphorothioates, phosphorodithioates, phosphotriesters, aminoalkylphosphotriesters, methyl and other alkyl phosphonates including 3'-alkylene phosphonates, 5'-alkylene phosphonates, phosphinates, phosphoramidates including 3'-amino phosphoramidate and aminoalkylphosphoramidates, thionophosphoramidates, thionoalkylphosphonates, thionoalkylphosphotriesters, selenophosphates, and boranophosphates having normal 3'-5' linkages, 2'-5' linked analogs of these, and those having inverted polarity wherein one or more internucleotide linkages is a 3' to 3', 5' to 5' or 2' to 2' linkage.

The Cascade Assay Employing Blocked Nucleic Acids

Figure 2A:
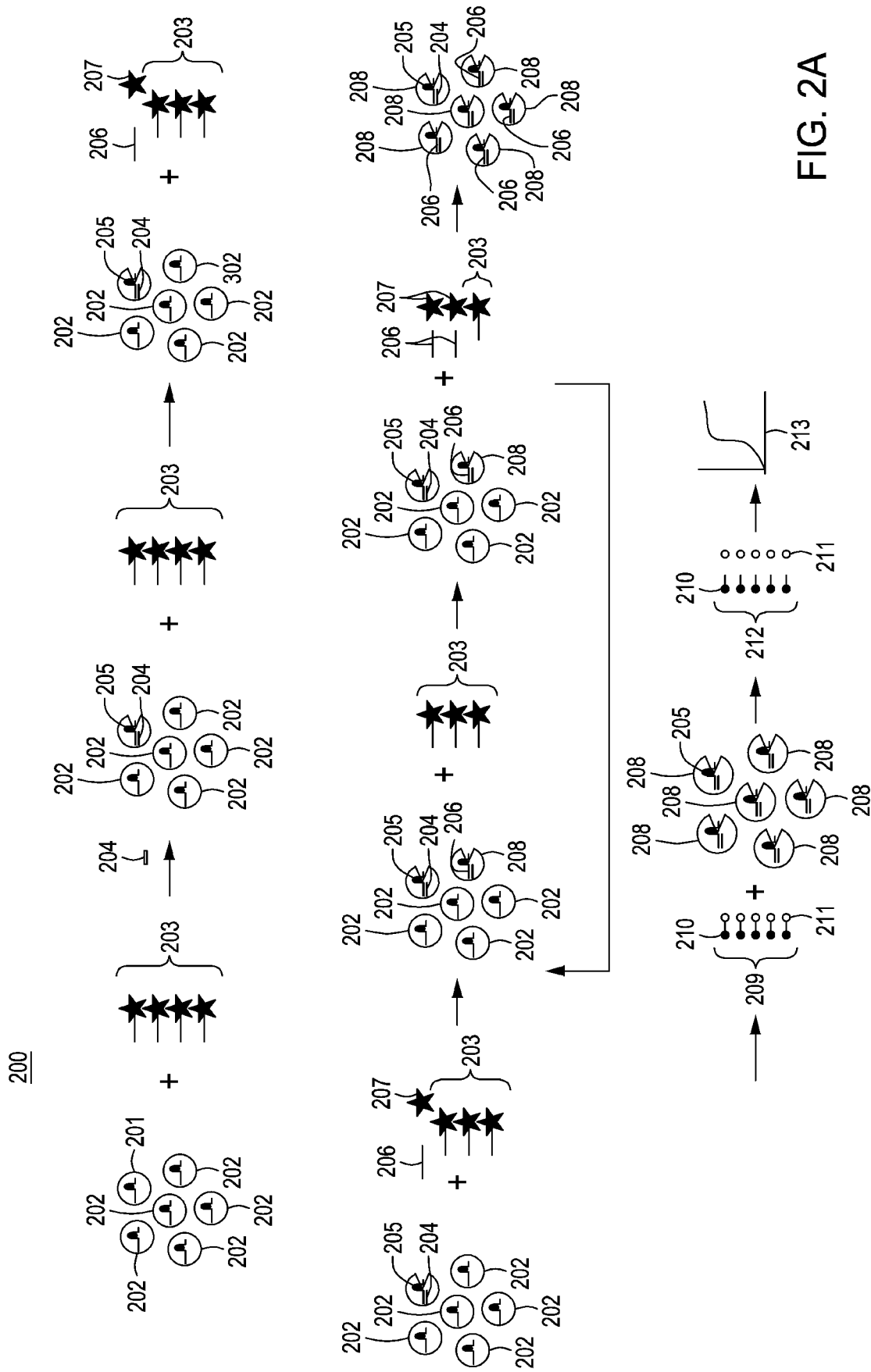
FIG. 2A is a diagram showing the sequence of steps in an exemplary cascade assay utilizing blocked nucleic acids.

FIG. 1B depicts the cascade assay generally. A specific embodiment of the cascade assay utilizing blocked nucleic acids is depicted in FIG. 2A. In this embodiment, a blocked nucleic acid is used to prevent the activation of RNP2 in the absence of a target nucleic acid of interest. The method in FIG. 2A begins with providing the cascade assay components RNP1 (201), RNP2 (202) and blocked nucleic acid molecules (203). RNP1 (201) comprises a gRNA specific for a target nucleic acid of interest and a nucleic acid-guided nuclease (e.g., Cas 12a or Cas 14 for a DNA target nucleic acid of interest or a Cas 13a for an RNA target nucleic acid of interest) and RNP2 (202) comprises a gRNA specific for an unblocked nucleic acid molecule and a nucleic acid-guided nuclease (again, Cas 12a or Cas 14 for a DNA unblocked nucleic acid molecule or a Cas 13a for an RNA unblocked nucleic acid molecule). As described above, the nucleic acid-guided nucleases in RNP1 (201) and RNP2 (202) can be the same or different depending on the type of target nucleic acid of interest and unblocked nucleic acid molecule. What is key, however, is that the nucleic acid-guided nucleases in RNP1 and RNP2 may be activated to have trans-cleavage activity following initiation of cis-cleavage activity.

In a first step, a sample comprising a target nucleic acid of interest (204) is added to the cascade assay reaction mix. The target nucleic acid of interest (204) combines with and activates RNP1 (205) but does not interact with or activate RNP2 (202). Once activated, RNP1 cuts the target nucleic acid of interest (204) via sequence-specific cis-cleavage, which then activates non-specific trans-cleavage of other nucleic acids present in the reaction mix, including the blocked nucleic acid molecules (203). At least one of the blocked nucleic acid molecules (203) becomes an unblocked nucleic acid molecule (206) when the blocking moiety (207) is removed. As described below, "blocking moiety" may refer to nucleoside modifications, topographical configurations such as secondary structures, and/or structural modifications.

Once at least one of the blocked nucleic acid molecules (203) is unblocked, the unblocked nucleic acid molecule (206) can then interact with and activate an RNP2 (208) complex. Because the nucleic acid-guided nucleases in the RNP1x (205) and RNP2x (208) have both cis- and trans-cleavage activity, more blocked nucleic acid molecules (203) become unblocked nucleic acid molecules (206) triggering activation of more RNP2 (208) complexes and more trans-cleavage activity in a cascade. FIG. 2A at bottom depicts the concurrent activation of reporter moieties. Intact reporter moieties (209) comprise a quencher (210) and a fluorophore (211) linked by a nucleic acid sequence. As described above in relation to FIG. 1B, the reporter moieties are also subject to trans-cleavage by activated RNP1 (205) and RNP2 (208). The intact reporter moieties (209) become activated reporter moieties (212) when the quencher (210) is separated from the fluorophore (211), emitting a fluorescent signal (213). Signal strength increases rapidly as more blocked nucleic acid molecules (203) become unblocked nucleic acid molecules (206) triggering cis-cleavage activation of more RNP2s (208) and thus more trans-cleavage activity of the reporter moieties (209). Again, here the reporter moieties are shown as separate molecules from the blocked nucleic acid molecules, but other configurations may be employed and are discussed in relation to FIG. 4. One particularly advantageous feature of the cascade assay is that, with the exception of the gRNA in the RNP1 (gRNA1), the cascade assay components are modular in the sense that the components stay the same no matter what target nucleic acid(s) of interest are being detected.

Figure 2B:
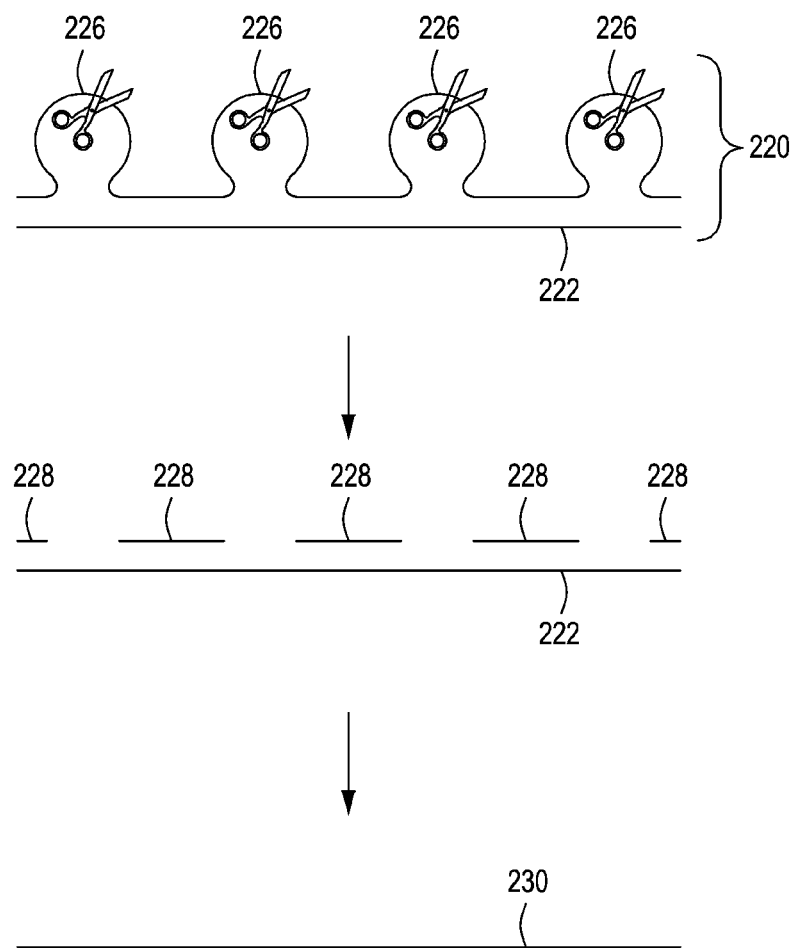
FIG. 2B is a diagram showing an exemplary blocked nucleic acid molecule and a method for unblocking the blocked nucleic acid molecules of the disclosure.

FIG. 2B is a diagram showing an exemplary blocked nucleic acid molecule (220) and an exemplary technique for unblocking the blocked nucleic acid molecules described herein. A blocked single-stranded or double-stranded, circular or linear, DNA or RNA molecule (220) comprising a target strand (222) may contain a partial hybridization with a complementary non-target strand nucleic acid molecule (224) containing unhybridized and cleavable secondary loop structures (226) (e.g., hairpin loops, tetraloops, pseudoknots, junctions, kissing hairpins, internal loops, bulges, and multibranch loops). Trans-cleavage of the loops by, e.g., activated RNP1s or RNP2s, generates short strand nucleotide sequences (228) which, because of the short length and low melting temperature $T_m$, can dehybridize at room temperature (e.g., 15°-25° C.), thereby unblocking the blocked nucleic acid molecule (220) to create an unblocked nucleic acid molecule (230), enabling the internalization of the unblocked nucleic acid molecule (230) (target strand) into an RNP2, leading to RNP2 activation.

Figure 2C:
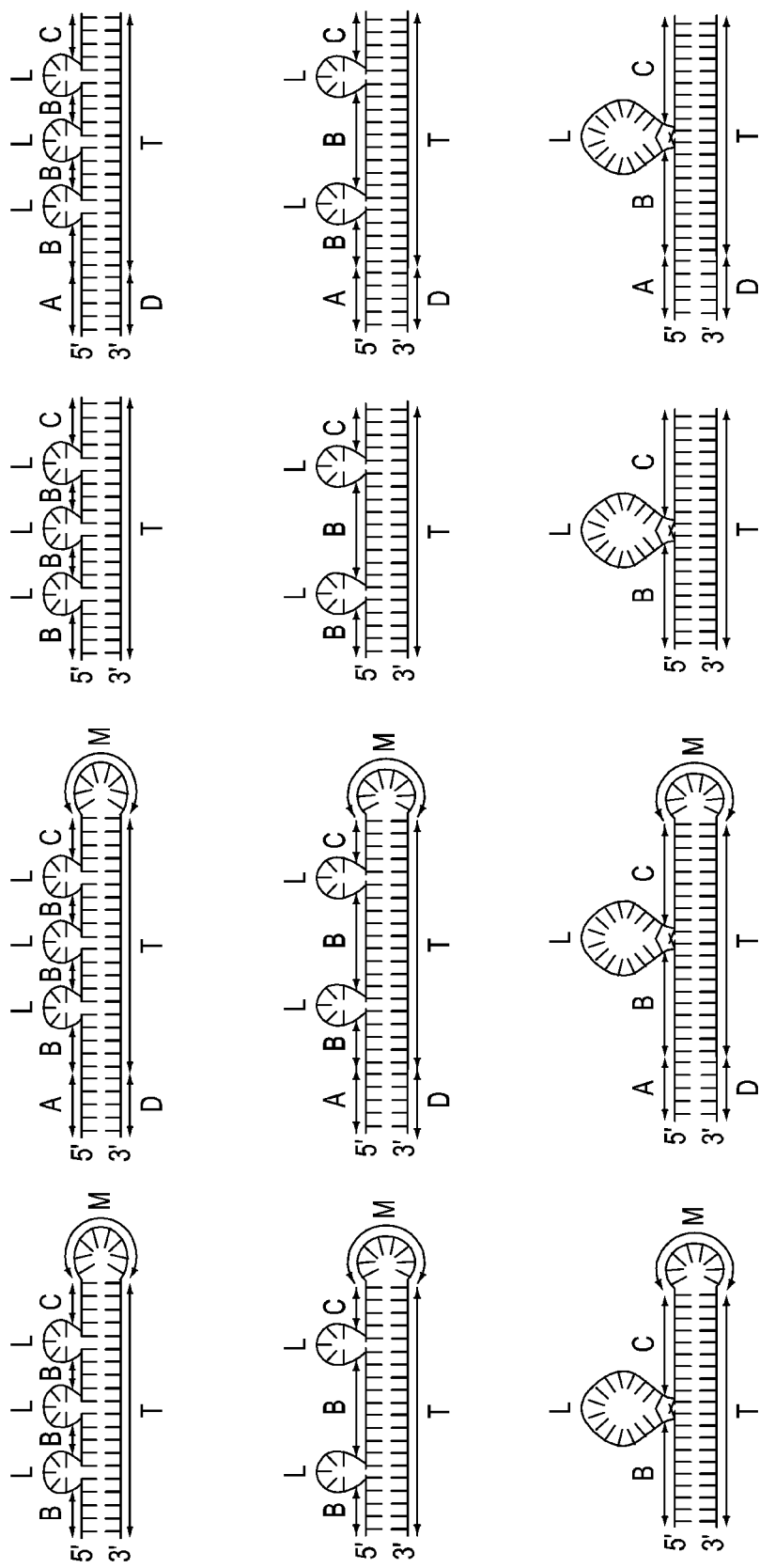
FIG. 2C shows schematics of several exemplary blocked nucleic acid molecules containing the structure of Formula I, as described herein.
Figure 2D:
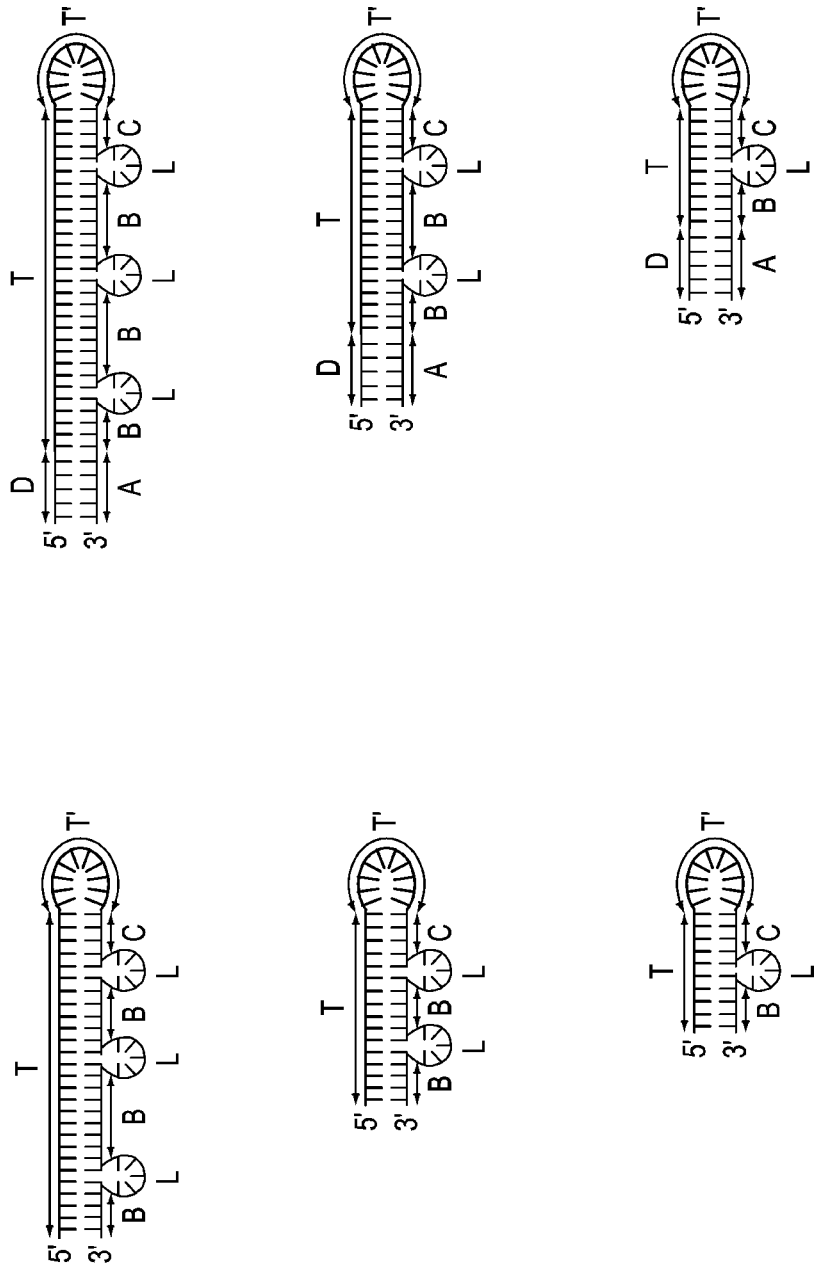
FIG. 2D shows schematics of several exemplary blocked nucleic acid molecules containing the structure of Formula II, as described herein.
Figure 2E:
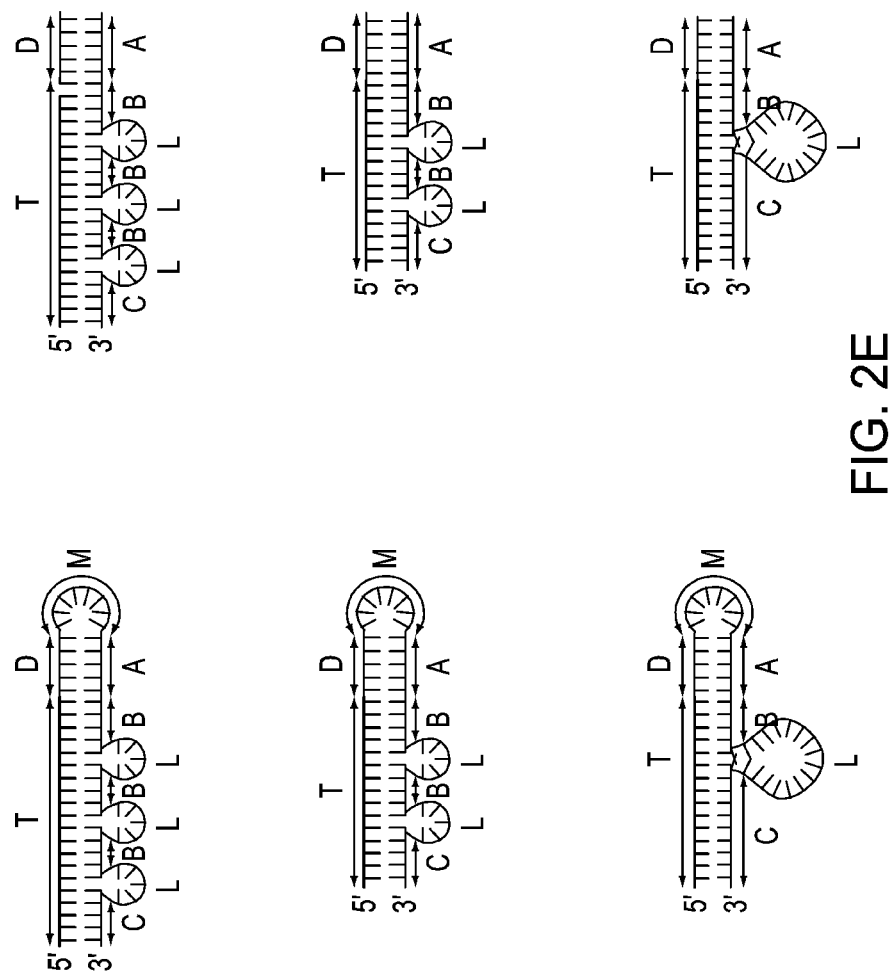
FIG. 2E shows schematics of several exemplary blocked nucleic acid molecules containing the structure of Formula III, as described herein.

A blocked nucleic acid molecule may be single-stranded or double-stranded, circular or linear, and may further contain a partially hybridized nucleic acid sequence containing cleavable secondary loop structures, as exemplified by "L" in FIGS. 2C-2E. Such blocked nucleic acids typically have a low binding affinity, or high dissociation constant ($K_d$) in relation to binding to RNP2 and may be referred to herein as a high $K_d$ nucleic acid molecule. In the context of the present disclosure, the binding of blocked or unblocked nucleic acid molecules or blocked or unblocked primer molecules to RNP2, low $K_d$ values range from about 100 fM to about 1 aM or lower (e.g., 100 zM) and high $K_d$ values are in the range of 100 nM to about 100 μM (10 mM) and thus are about $10^5$-, $10^6$-, $10^7$-, $10^8$-, $10^9$- to $10^{10}$-fold or higher as compared to low $K_d$ values.

The blocked nucleic acid molecules (high $K_d$ molecules) described herein can be converted into unblocked nucleic acid molecules (low $K_d$ molecules—also in relation to binding to RNP2) via cleavage of nuclease-cleavable regions (e.g., via active RNP1s and RNP2s). The unblocked nucleic acid molecule has a higher binding affinity for the gRNA in the RNP2 than does the blocked nucleic acid molecule, although there may be some "leakiness" where some blocked nucleic acid molecules are able to interact with the gRNA in the RNP2. However, an unblocked nucleic acid molecule has a substantially higher likelihood than a blocked nucleic acid molecule to hybridize with the gRNA of RNP2.

Once the unblocked nucleic acid molecule is bound to RNP2, the RNP2 activation triggers trans-cleavage activity, which in turn leads to more RNP2 activation by further cleaving blocked nucleic acid molecules, resulting in a positive feedback loop.

In embodiments where blocked nucleic acid molecules are linear and/or form a secondary structure, the blocked nucleic acid molecules may be single-stranded (ss) or double-stranded (ds) and contain a first nucleotide sequence and a second nucleotide sequence. The first nucleotide sequence has sufficient complementarity to hybridize to a gRNA of RNP2, and the second nucleotide sequence does not. The first and second nucleotide sequences of a blocked nucleic acid molecule may be on the same nucleic acid molecule (e.g., for single-strand embodiments) or on separate nucleic acid molecules (e.g., for double strand embodiments). Trans-cleavage (e.g., via RNP1 or RNP2) of the second nucleotide sequence converts the blocked nucleic acid molecule to a single-strand unblocked nucleic acid molecule. The unblocked nucleic acid molecule contains only the first nucleotide sequence, which has sufficient complementarity to hybridize to the gRNA of RNP2, thereby activating the trans-endonuclease activity of RNP2.

In some embodiments, the second nucleotide sequence at least partially hybridizes to the first nucleotide sequence, resulting in a secondary structure containing at least one loop (e.g., hairpin loops, tetraloops, pseudoknots, junctions, kissing hairpins, internal loops, bulges, and multibranch loops). Such loops block the nucleic acid molecule from binding or incorporating into an RNP complex in a manner to initiate trans cleavage (see, e.g., the exemplary structures in FIGS. 2C-2E).

Figure 2F:
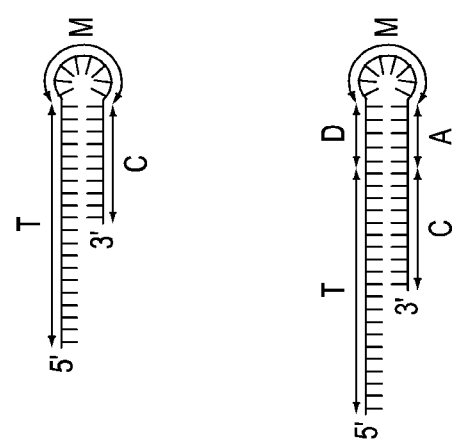
FIG. 2F shows schematics of several exemplary blocked nucleic acid molecules containing the structure of Formula IV, as described herein.
Figure 2G:
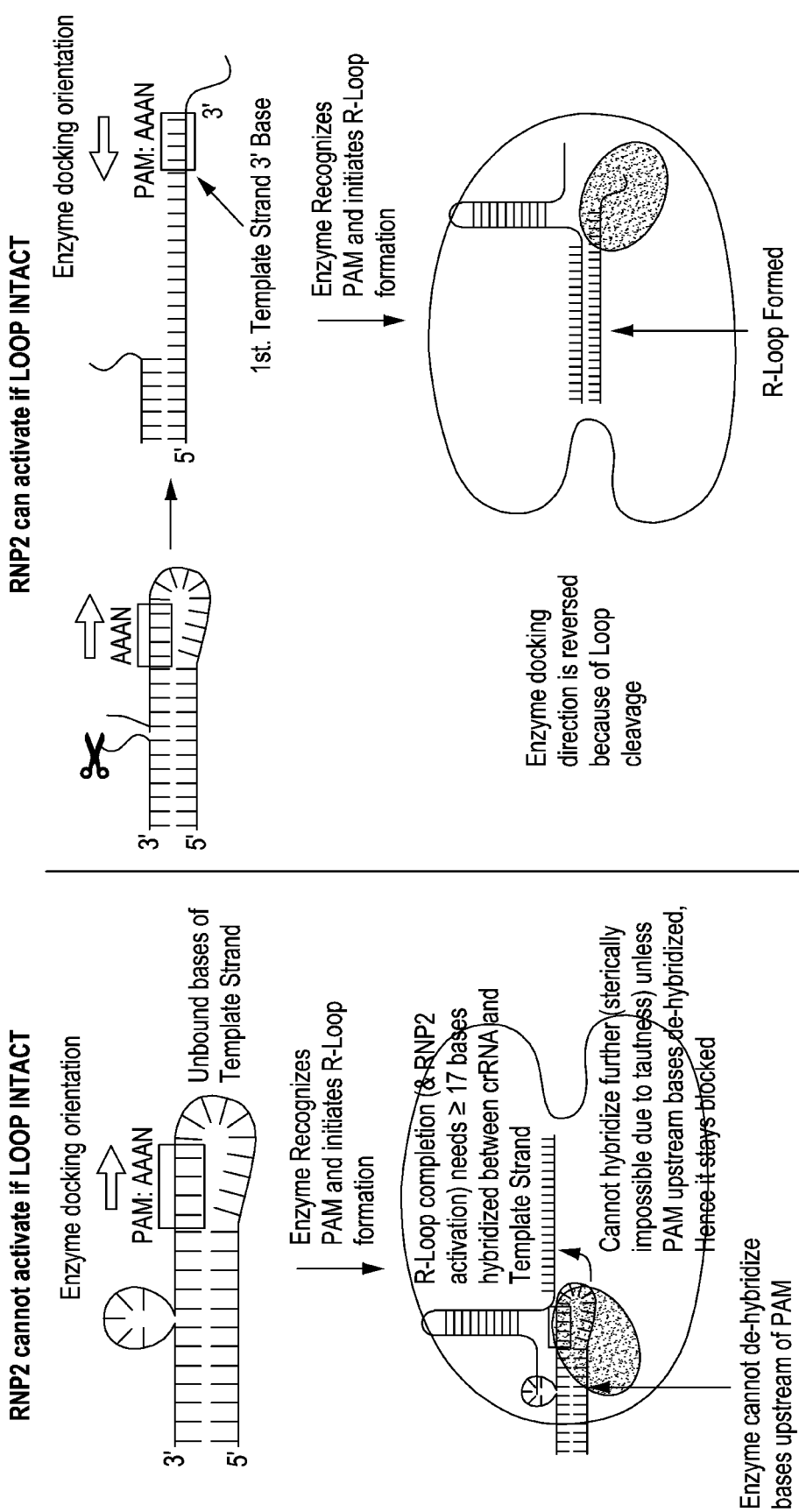
FIG. 2G shows an exemplary single-stranded blocked nucleic acid molecule with a design able to block R-loop formation with an RNP complex, thereby blocking activation of the trans-nuclease activity of an RNP complex (i.e., RNP2).

In some embodiments, the blocked nucleic acid molecule may contain a protospacer adjacent motif (PAM) sequence, or partial PAM sequence, positioned between the first and second nucleotide sequences, where the first sequence is 5' to the PAM sequence, or partial PAM sequence, (see FIG. 2G). Inclusion of a PAM sequence may increase the reaction kinetics internalizing the unblocked nucleic acid molecule into RNP2 and thus decrease the time to detection. In other embodiments, the blocked nucleic acid molecule does not contain a PAM sequence.

In some embodiments, the blocked nucleic acid molecules (i.e., high $K_d$ nucleic acid molecules—in relation to binding to RNP2) of the disclosure may include a structure represented by Formula I (e.g., FIG. 2C), Formula II (e.g., FIG. 2D), Formula III (e.g., FIG. 2E), or Formula IV (e.g., FIG. 2F) wherein Formulas I-IV are in the 5'-to-3' direction:

A-(B-L)J-C-M-T-D    (Formula I);

wherein A is 0-15 nucleotides in length;
B is 4-12 nucleotides in length;
L is 3-25 nucleotides in length;
J is an integer between 1 and 10;
C is 4-15 nucleotides in length;
M is 1-25 nucleotides in length or is absent, wherein if M is absent then A-(B-L)J-C and T-D are separate nucleic acid strands;
T is 17-135 nucleotides in length (e.g., 17-100, 17-50, or 17-25) and comprises a sequence complementary to B and C; and
D is 0-10 nucleotides in length and comprises a sequence complementary to A;

D-T-T'-C-(L-B)J-A    (Formula II);

wherein D is 0-10 nucleotides in length;
T-T' is 17-135 nucleotides in length (e.g., 17-100, 17-50, or 17-25);
T' is 1-10 nucleotides in length and does not hybridize with T;
C is 4-15 nucleotides in length and comprises a sequence complementary to T;
L is 3-25 nucleotides in length and does not hybridize with T;
B is 4-12 nucleotides in length and comprises a sequence complementary to T;
J is an integer between 1 and 10;
A is 0-15 nucleotides in length and comprises a sequence complementary to D;

T-D-M-A-(B-L)J-C    (Formula III);

wherein T is 17-135 nucleotides in length (e.g., 17-100, 17-50, or 17-25);
D is 0-10 nucleotides in length;
M is 1-25 nucleotides in length or is absent, wherein if M is absent then T-D and A-(B-L)J-C are separate nucleic acid strands;
A is 0-15 nucleotides in length and comprises a sequence complementary to D;
B is 4-12 nucleotides in length and comprises a sequence complementary to T;
L is 3-25 nucleotides in length;
J is an integer between 1 and 10; and
C is 4-15 nucleotides in length;

T-D-M-A-Lp-C    (Formula IV);

wherein T is 17-31 nucleotides in length (e.g., 17-100, 17-50, or 17-25);
D is 0-15 nucleotides in length;
M is 1-25 nucleotides in length;
A is 0-15 nucleotides in length and comprises a sequence complementary to D; and
L is 3-25 nucleotides in length;
p is 0 or 1;
C is 4-15 nucleotides in length and comprises a sequence complementary to T.

In alternative embodiments of any of these molecules, T (or T-T') can have a maximum length of 1000 nucleotides, e.g., at most 200, at most 135, at most 75, at most 50, or at most 25.

Nucleotide mismatches can be introduced in any of the above structures containing double strand segments (for example, where M is absent in Formula I or Formula III) to reduce the melting temperature (Tm) of the segment such that once the loop (L) is cleaved, the double strand segment is unstable and dehybridizes rapidly. The percentage of nucleotide mismatches of a given segment may vary between 0% and 50%; however, the maximum number of nucleotide mismatches is limited to a number where the secondary loop structure still forms. "Segments" in the above statement refers to A, B, and C. In other words, the number of hybridized bases can be less than or equal to the length of each double strand segment and vary based on number of mismatches introduced.

In any blocked nucleic acid molecule having the structure of Formula I, III, or IV, T will have sequence complementarity to a nucleotide sequence (e.g., a spacer sequence) within a gRNA of RNP2. The nucleotide sequence of T is to be designed such that hybridization of T to the gRNA of RNP2 activates the trans-nuclease activity of RNP2. In any blocked nucleic acid molecule having structure of Formula II, T-T' will have sequence complementarity to a sequence (e.g., a spacer sequence) within the gRNA of RNP2. The nucleotide sequence of T-T' is to be designed such that hybridization of T-T' to the gRNA of RNP2 activates the trans-nuclease activity of RNP2. For T or T-T', full complementarity to the gRNA is not necessarily required, provided there is sufficient complementarity to cause hybridization and trans-cleavage activation of RNP2.

Exemplary nucleotide sequences of blocked nucleic acid molecules (e.g., SEQ ID NOs: 14-1421) include those in Table 1.

TABLE 1

Nucleotide sequences of blocked nucleic acid molecules.

| SEQ ID NO: | Sequence |
|---|---|
| SEQ ID NO: 14 | GATACTTTTTATTTTTTATATATATATATATTTTTATTTTTATATATATATATATAGTATC |
| SEQ ID NO: 15 | GACACTTTTTATTTTTTATATATATATATATTTTTATTTTTATATATATATATATAGTGTC |
| SEQ ID NO: 16 | GATACTTTTTATTTTGATATATATATATATTTTTATTTTTATATATATATATATCGTATC |
| SEQ ID NO: 17 | GGATCTTTTTATTTTTTATATATATATATATTTTTATTTTTATATATATATATATAGATCC |
| SEQ ID NO: 18 | GACACTTTTTATTTTGATATATATATATATTTTTATTTTTATATATATATCGTGTC |
| SEQ ID NO: 19 | GGATCTTTTTATTTTGATATATATATATATTTTTATTTTTATATATATATCGATCC |
| SEQ ID NO: 20 | GCGTCTTTTTATTTTTTATATATATATATATTTTTATTTTTATATATATATATATAGACGC |
| SEQ ID NO: 21 | GCGTCTTTTTATTTTGATATATATATATATTTTTATTTTTATATATATATCGACGC |
| SEQ ID NO: 22 | GTATACTTTTTATTTTTTATATATATATATATTTTTATTTTTATATATATATATATAGTATAC |
| SEQ ID NO: 23 | GTGATCTTTTTATTTTTTATATATATATATATTTTTATTTTTATATATATATATATAGATCAC |
| SEQ ID NO: 24 | GTATACTTTTTATTTTGATATATATATATATTTTTATTTTTATATATATATATATCGTATAC |
| SEQ ID NO: 25 | GTATACTTTTTATTTTGATATATGTATATATTTTTATTTTTATACATATATCGTATAC |
| SEQ ID NO: 26 | GGATACTTTTTATTTTTTATATATATATATATTTTTATTTTTATATATATATAGTATCC |
| SEQ ID NO: 27 | GTGATCTTTTTATTTTGATATATATATATATTTTTATTTTTATATATATATCGATCAC |
| SEQ ID NO: 28 | GTGATCTTTTTATTTTGATATATGTATATATTTTTATTTTTATACATATATCGATCAC |
| SEQ ID NO: 29 | GGATACTTTTTATTTTGATATATATATATATTTTTATTTTTATATATATATCGTATCC |
| SEQ ID NO: 30 | GGATACTTTTTATTTTGATATATGTATATATTTTTATTTTTATACATATATCGTATCC |
| SEQ ID NO: 31 | GCGATCTTTTTATTTTTTATATATATATATATTTTTATTTTTATATATATATAGATCGC |
| SEQ ID NO: 32 | GCGATCTTTTTATTTTGATATATATATATATTTTTATTTTTATATATATATCGATCGC |
| SEQ ID NO: 33 | GCGATCTTTTTATTTTGATATATGTATATATTTTTATTTTTATACATATATCGATCGC |
| SEQ ID NO: 34 | GATATACTTTTTATTTTTTATATATATATATATTTTTATTTTTATATATATATAGTATATC |
| SEQ ID NO: 35 | GATATATTTTTATTTTGATATATATATATATTTTTATTTTTATATATATATCATATATC |
| SEQ ID NO: 36 | GATATATTTTTATTTTGATATATGTATATTTTTATTTTTATACATATATCATATATC |

TABLE 1-continued

Nucleotide sequences of blocked nucleic acid molecules.

| SEQ ID NO: | Sequence |
|---|---|
| SEQ ID NO: 37 | GTGATACTTTTATTTTTATATATATATATTTTTATTTTTATATATATATAGTATCAC |
| SEQ ID NO: 38 | GATATACTTTTATTTTTGATATATATATATTTTTATTTTTATATATATATCGTATATC |
| SEQ ID NO: 39 | GATATACTTTTATTTTTGATATATGTATATTTTTATTTTTATATACATATATCGTATATC |
| SEQ ID NO: 40 | GGTATACTTTTATTTTTATATATATATATTTTTATTTTTATATATATATAGTATACC |
| SEQ ID NO: 41 | GTGATACTTTTATTTTTGATATATATATATTTTTATTTTTATATATATATCGTATCAC |
| SEQ ID NO: 42 | GTGATACTTTTATTTTTGATATATGTATATTTTTATTTTTATATACATATATCGTATCAC |
| SEQ ID NO: 43 | GGTATACTTTTATTTTTGATATATATATATTTTTATTTTTATATATATATCGTATACC |
| SEQ ID NO: 44 | GGTATACTTTTATTTTTGATATATGTATATTTTTATTTTTATATACATATATCGTATACC |
| SEQ ID NO: 45 | GGTGTACTTTTATTTTTATATATATATATTTTTATTTTTATATATATATAGTACACC |
| SEQ ID NO: 46 | GGTGTACTTTTATTTTTGATATATATATATTTTTATTTTTATATATATATCGTACACC |
| SEQ ID NO: 47 | GGTGTACTTTTATTTTTGATATATGTATATTTTTATTTTTATATACATATATCGTACACC |
| SEQ ID NO: 48 | GTATACTTTTATTTTTTATATATATATATTTTTATTTTTATATATATATAGTATATAC |
| SEQ ID NO: 49 | GTATACTTTTATTTTTGATATATATATATTTTTATTTTTATATATATATCGTATATAC |
| SEQ ID NO: 50 | GTATACTTTTATTTTTGATATATGTATATTTTTATTTTTATACATATATCGTATATAC |
| SEQ ID NO: 51 | GTATACTTTTATTTTTGATCATGTATATTTTTATTTTTATATACATGATCGTATATAC |
| SEQ ID NO: 52 | GTATACTTTTATTTTTGATCATATATGTTTTTATTTTTACATATATGATCGTATATAC |
| SEQ ID NO: 53 | GGATATACTTTTATTTTTTATATATATATATTTTTATTTTTATATATATATAGTATATCC |
| SEQ ID NO: 54 | GGATATACTTTTATTTTTGATATATATATATTTTTATTTTTATATATATATCGTATATCC |
| SEQ ID NO: 55 | GGATATACTTTTATTTTTGATATATGTATATTTTTATTTTTATACATATATCGTATATCC |
| SEQ ID NO: 56 | GGATATACTTTTATTTTTGATCATGTATATTTTTATTTTTATATACATGATCGTATATCC |
| SEQ ID NO: 57 | GGATATACTTTTATTTTTGATCATATATGTTTTTATTTTTACATATATGATCGTATATCC |
| SEQ ID NO: 58 | GGTGATACTTTTATTTTTTATATATATATATTTTTATTTTTATATATATAGTATCACC |
| SEQ ID NO: 59 | GGTGATACTTTTATTTTTGATATATATATATTTTTATTTTTATATATATATCGTATCACC |
| SEQ ID NO: 60 | GGTGATACTTTTATTTTTGATATATGTATATTTTTATTTTTATACATATATCGTATCACC |
| SEQ ID NO: 61 | GGTGATACTTTTATTTTTGATCATGTATATTTTTATTTTTATATACATGATCGTATCACC |

TABLE 1-continued

Nucleotide sequences of blocked nucleic acid molecules.

| SEQ ID NO: | Sequence |
|---|---|
| SEQ ID NO: 62 | GGTGATACTTTTTATTTTTGATCATATATGTTTTTTATTTTTACATATATGATCGTATCACC |
| SEQ ID NO: 63 | GGTGATCCTTTTTATTTTTTATATATATATATTTTTATTTTTTATATATATAGGATCACC |
| SEQ ID NO: 64 | GGTGATCCTTTTTATTTTTGATATATATATATTTTTATTTTTTATATATATCGGATCACC |
| SEQ ID NO: 65 | GGTGATCCTTTTTATTTTTGATATATGTATATTTTTATTTTTTATACATATATCGGATCACC |
| SEQ ID NO: 66 | GGTGATCCTTTTTATTTTTGATCATGTATATTTTTATTTTTATATACATGATCGGATCACC |
| SEQ ID NO: 67 | GGTGATCCTTTTTATTTTTGATCATATATGTTTTTTATTTTTACATATATGATCGGATCACC |
| SEQ ID NO: 68 | GATATATCACTTTTTATTTTTTATATATATATTTTTATTTTTTATATATAGTGATATATC |
| SEQ ID NO: 69 | GTATATACATTTTTATTTTTGATATATATATTTTTATTTTTTATATATCATGTATATAC |
| SEQ ID NO: 70 | GTATATACATTTTTATTTTTGATATATGTATTTTTATTTTTTACATATATCATGTATATAC |
| SEQ ID NO: 71 | GTATATACATTTTTATTTTTGATCATGTATTTTTATTTTTATACATGATCATGTATATAC |
| SEQ ID NO: 72 | GTATATACATTTTTATTTTTGATCATATATTTTTATTTTTATATATGATCATGTATATAC |
| SEQ ID NO: 73 | GGATATACACTTTTTATTTTTTATATATATATTTTTATTTTTTATATATAGTGTATATCC |
| SEQ ID NO: 74 | GGATATACATTTTTATTTTTGATATATATATTTTTATTTTTTATATATCATGTATATCC |
| SEQ ID NO: 75 | GGATATACATTTTTATTTTTGATATATGTATTTTTATTTTTTACATATATCATGTATATCC |
| SEQ ID NO: 76 | GGATATACATTTTTATTTTTGATCATGTATTTTTATTTTTATACATGATCATGTATATCC |
| SEQ ID NO: 77 | GGATATACATTTTTATTTTTGATCATATATTTTTATTTTTATATGATCATGTATATCC |
| SEQ ID NO: 78 | GGGTATATACTTTTTATTTTTTATATATATATTTTTATTTTTTATATATAGTATATACCC |
| SEQ ID NO: 79 | GGATATACACTTTTTATTTTTGATATATATATTTTTATTTTTTATATATCGTGTATATCC |
| SEQ ID NO: 80 | GGATATACACTTTTTATTTTTGATATATGTATTTTTATTTTTTACATATATCGTGTATATCC |
| SEQ ID NO: 81 | GGATATACACTTTTTATTTTTGATCATGTATTTTTATTTTTATACATGATCGTGTATATCC |
| SEQ ID NO: 82 | GGATATACACTTTTTATTTTTGATCATATATTTTTATTTTTATATGATCGTGTATATCC |
| SEQ ID NO: 83 | GGGTATATACTTTTTATTTTTGATATATATATTTTTATTTTTTATATATCGTATATACCC |
| SEQ ID NO: 84 | GGGTATATACTTTTTATTTTTGATATATGTATTTTTATTTTTTACATATATCGTATATACCC |
| SEQ ID NO: 85 | GGGTATATACTTTTTATTTTTGATCATGTATTTTTATTTTTATACATGATCGTATATACCC |
| SEQ ID NO: 86 | GGGTATATACTTTTTATTTTTGATCATATATTTTTATTTTTATATGATCGTATATACCC |

TABLE 1-continued

Nucleotide sequences of blocked nucleic acid molecules.

| SEQ ID NO: | Sequence |
|---|---|
| SEQ ID NO: 87 | GGATGTACACTTTTTATTTTTTATATATATATTTTTATTTTTTAT ATATATAGTGTACATCC |
| SEQ ID NO: 88 | GGATGTACACTTTTTATTTTTGATATATATATTTTTATTTTTTAT ATATATCGTGTACATCC |
| SEQ ID NO: 89 | GGATGTACACTTTTTATTTTTGATATATGTATTTTTATTTTTTAC ATATATCGTGTACATCC |
| SEQ ID NO: 90 | GGATGTACACTTTTTATTTTTGATCATGTATTTTTATTTTTATA CATGATCGTGTACATCC |
| SEQ ID NO: 91 | GGATGTACACTTTTTATTTTTGATCATATATTTTTATTTTTATA TATGATCGTGTACATCC |
| SEQ ID NO: 92 | GTATATACTTTTTATTTTTTATATATATATATATTTTTATTTTT ATATATATATATAGTATATAC |
| SEQ ID NO: 93 | GTATATACTTTTTATTTTTGATATATATATATATTTTTATTTTT ATATATATATATCGTATATAC |
| SEQ ID NO: 94 | GGATATACTTTTTATTTTTTATATATATATATATTTTTATTTTT ATATATATATATAGTATATCC |
| SEQ ID NO: 95 | GGATATACTTTTTATTTTTGATATATATATATATTTTTATTTTT ATATATATATATCGTATATCC |
| SEQ ID NO: 96 | GGTGATACTTTTTATTTTTTATATATATATATATTTTTATTTTT ATATATATATATAGTATCACC |
| SEQ ID NO: 97 | GGTGATACTTTTTATTTTTGATATATATATATATTTTTATTTTT ATATATATATATCGTATCACC |
| SEQ ID NO: 98 | GGTGATCCTTTTTATTTTTTATATATATATATATTTTTATTTTT ATATATATATATAGGATCACC |
| SEQ ID NO: 99 | GGTGATCCTTTTTATTTTTGATATATATATATATTTTTATTTTT ATATATATATATCGGATCACC |
| SEQ ID NO: 100 | GATATATCACTTTTTATTTTTTATATATATATATATTTTTTATTT TTATATATATATATAGTGATATATC |
| SEQ ID NO: 101 | GTATATACATTTTTATTTTTGATATATATATATATTTTTTATTT TTATATATATATATCATGTATATAC |
| SEQ ID NO: 102 | GGATATACACTTTTTATTTTTTATATATATATATATTTTTTATTT TTATATATATATATAGTGTATATCC |
| SEQ ID NO: 103 | GGATATACATTTTTATTTTTGATATATATATATATTTTTTATTT TTATATATATATATCATGTATATCC |
| SEQ ID NO: 104 | GGGTATATACTTTTTATTTTTTATATATATATATATTTTTTATTT TTATATATATATATAGTATATACCC |
| SEQ ID NO: 105 | GGATATACACTTTTTATTTTTGATATATATATATATTTTTTATTT TTATATATATATATCGTGTATATCC |
| SEQ ID NO: 106 | GGGTATATACTTTTTATTTTTGATATATATATATATTTTTTATTT TTATATATATATATCGTATATACCC |
| SEQ ID NO: 107 | GTATATACTTTTTATTTTTTATATATATATATATTTTTATTTTTT ATATATATATAGTATATAC |
| SEQ ID NO: 108 | GTATATACTTTTTATTTTTGATATATATATATATTTTTATTTTTT ATATATATATCGTATATAC |
| SEQ ID NO: 109 | GTATATACTTTTTATTTTTGATATATGTATATATTTTTATTTTTT ATATACATATATCGTATATAC |
| SEQ ID NO: 110 | GGATATACTTTTTATTTTTTATATATATATATATTTTTATTTTTT ATATATATATAGTATATCC |
| SEQ ID NO: 111 | GGATATACTTTTTATTTTTGATATATATATATATTTTTATTTTTT ATATATATATCGTATATCC |

TABLE 1-continued

Nucleotide sequences of blocked nucleic acid molecules.

| SEQ ID NO: | Sequence |
| --- | --- |
| SEQ ID NO: 112 | GGATATACTTTTTATTTTTGATATATGTATATATTTTTATTTTT<br>ATATACATATATCGTATATCC |
| SEQ ID NO: 113 | GGTGATACTTTTTATTTTTTATATATATATATATTTTTATTTTT<br>ATATATATATATAGTATCACC |
| SEQ ID NO: 114 | GGTGATACTTTTTATTTTTGATATATATATATATTTTTATTTTT<br>ATATATATATATCGTATCACC |
| SEQ ID NO: 115 | GGTGATACTTTTTATTTTTGATATATGTATATATTTTTATTTTT<br>ATATACATATATCGTATCACC |
| SEQ ID NO: 116 | GGTGATCCTTTTTATTTTTTATATATATATATATTTTTATTTTT<br>ATATATATATATAGGATCACC |
| SEQ ID NO: 117 | GGTGATCCTTTTTATTTTTGATATATATATATATTTTTATTTTT<br>ATATATATATATCGGATCACC |
| SEQ ID NO: 118 | GGTGATCCTTTTTATTTTTGATATATGTATATATTTTTATTTTT<br>ATATACATATATCGGATCACC |
| SEQ ID NO: 119 | GATATATCACTTTTTATTTTTTATATATATATATATTTTTATTTT<br>TTATATATATATAGTGATATATC |
| SEQ ID NO: 120 | GTATATACATTTTTTATTTTTGATATATATATATATTTTTATTTT<br>TTATATATATATATCATGTATATAC |
| SEQ ID NO: 121 | GTATATACATTTTTTATTTTTGATATATGTATATATTTTTATTTT<br>TTATACATATATCATGTATATAC |
| SEQ ID NO: 122 | GGATATACACTTTTTATTTTTTATATATATATATATTTTTATTTT<br>TTATATATATATAGTGTATATCC |
| SEQ ID NO: 123 | GGATATACATTTTTTATTTTTGATATATATATATATTTTTATTTT<br>TTATATATATATATCATGTATATCC |
| SEQ ID NO: 124 | GGATATACATTTTTTATTTTTGATATATGTATATATTTTTATTTT<br>TTATACATATATCATGTATATCC |
| SEQ ID NO: 125 | GGGTATATACTTTTTATTTTTTATATATATATATATTTTTATTTT<br>TTATATATATATAGTATATACCC |
| SEQ ID NO: 126 | GGATATACACTTTTTATTTTTGATATATATATATATTTTTATTTT<br>TTATATATATATATCGTGTATATCC |
| SEQ ID NO: 127 | GGATATACACTTTTTATTTTTGATATATGTATATATTTTTATTTT<br>TTATACATATATCGTGTATATCC |
| SEQ ID NO: 128 | GGGTATATACTTTTTATTTTTGATATATATATATATTTTTATTTT<br>TTATATATATATATCGTATATACCC |
| SEQ ID NO: 129 | GGGTATATACTTTTTATTTTTGATATATGTATATATTTTTATTTT<br>TTATACATATATCGTATATACCC |
| SEQ ID NO: 130 | GATATATCACTTTTTATTTTTTATATATATATATATTTTTATTTTT<br>ATATATATATATAGTGATATATC |
| SEQ ID NO: 131 | GTATATACATTTTTTATTTTTGATATATATATATATTTTTATTTTT<br>ATATATATATATCATGTATATAC |
| SEQ ID NO: 132 | GTATACATTTTTATTTTTGATATATGTATATTTTTATTTTT<br>ATATACATATATCATGTATATAC |
| SEQ ID NO: 133 | GGATATACACTTTTTATTTTTTATATATATATATATTTTTATTTTT<br>ATATATATATATAGTGTATATCC |
| SEQ ID NO: 134 | GGATATACATTTTTTATTTTTGATATATATATATATTTTTATTTTT<br>ATATATATATATCATGTATATCC |
| SEQ ID NO: 135 | GGATATACATTTTTTATTTTTGATATATGTATATATTTTTATTTTT<br>ATATACATATATCATGTATATCC |
| SEQ ID NO: 136 | GGGTATATACTTTTTATTTTTTATATATATATATATTTTTATTTTT<br>ATATATATATATAGTATATACCC |

TABLE 1-continued

Nucleotide sequences of blocked nucleic acid molecules.

| SEQ ID NO: | Sequence |
| --- | --- |
| SEQ ID NO: 137 | GGATATACACTTTTTATTTTTGATATATATATATTTTTATTTTT ATATATATATATCGTGTATATCC |
| SEQ ID NO: 138 | GGATATACACTTTTTATTTTTGATATATGTATATTTTTATTTTT ATATACATATATCGTGTATATCC |
| SEQ ID NO: 139 | GGGTATATACTTTTTATTTTTGATATATATATATTTTTATTTTT ATATATATATATCGTATATACCC |
| SEQ ID NO: 140 | GGGTATATACTTTTTATTTTTGATATATGTATATTTTTATTTTT ATATACATATATCGTATATACCC |
| SEQ ID NO: 141 | GATATATCACTTTTTATTTTTTATATATATATATTTTTATTTTT ATATATATATAGTGATATATC |
| SEQ ID NO: 142 | GTATATACATTTTTATTTTTGATATATATATATTTTTATTTTT ATATATATCATGTATATAC |
| SEQ ID NO: 143 | GTATATACATTTTTATTTTTGATATATGTATATTTTTATTTTT ATACATATATCATGTATATAC |
| SEQ ID NO: 144 | GTATATACATTTTTATTTTTGATCATGTATATTTTTATTTTTA TATACATGATCATGTATATAC |
| SEQ ID NO: 145 | GTATATACATTTTTATTTTTGATCATATATGTTTTTATTTTTA CATATATGATCATGTATATAC |
| SEQ ID NO: 146 | GGATATACACTTTTTATTTTTTATATATATATATTTTTATTTTT ATATATATATAGTGTATATCC |
| SEQ ID NO: 147 | GGATATACATTTTTATTTTTGATATATATATATTTTTATTTTT ATATATATATCATGTATATCC |
| SEQ ID NO: 148 | GGATATACATTTTTATTTTTGATATATGTATATTTTTATTTTT ATACATATATCATGTATATCC |
| SEQ ID NO: 149 | GGATATACATTTTTATTTTTGATCATGTATATTTTTATTTTTA TATACATGATCATGTATATCC |
| SEQ ID NO: 150 | GGATATACATTTTTATTTTTGATCATATATGTTTTTATTTTTA CATATATGATCATGTATATCC |
| SEQ ID NO: 151 | GGGTATATACTTTTTATTTTTTATATATATATATTTTTATTTTT ATATATATATAGTATATACCC |
| SEQ ID NO: 152 | GGATATACACTTTTTATTTTTGATATATATATATTTTTATTTTT ATATATATATCGTGTATATCC |
| SEQ ID NO: 153 | GGATATACACTTTTTATTTTTGATATATGTATATTTTTATTTTT ATACATATATCGTGTATATCC |
| SEQ ID NO: 154 | GGATATACACTTTTTATTTTTGATCATGTATATTTTTATTTTTA TATACATGATCGTGTATATCC |
| SEQ ID NO: 155 | GGATATACACTTTTTATTTTTGATCATATATGTTTTTATTTTTA CATATATGATCGTGTATATCC |
| SEQ ID NO: 156 | GGGTATATACTTTTTATTTTTGATATATATATATTTTTATTTTT ATATATATATCGTATATACCC |
| SEQ ID NO: 157 | GGGTATATACTTTTTATTTTTGATATATGTATATTTTTATTTTT ATACATATATCGTATATACCC |
| SEQ ID NO: 158 | GGGTATATACTTTTTATTTTTGATCATGTATATTTTTATTTTTA TATACATGATCGTATATACCC |
| SEQ ID NO: 159 | GGGTATATACTTTTTATTTTTGATCATATATGTTTTTATTTTTA CATATATGATCGTATATACCC |
| SEQ ID NO: 160 | GTACATATATTTTTTATTTTTGATATATATATATTTTTATTTTTA TATATATCAATATATGTAC |
| SEQ ID NO: 161 | GTACATATATTTTTTATTTTTGATATATGTATTTTTATTTTTTA CATATATCAATATATGTAC |

TABLE 1-continued

Nucleotide sequences of blocked nucleic acid molecules.

| SEQ ID NO: | Sequence |
| --- | --- |
| SEQ ID NO: 162 | GTACATATATTTTTTATTTTTGATCATGTATTTTTTATTTTTAT ACATGATCAATATATGTAC |
| SEQ ID NO: 163 | GTACATATATTTTTTATTTTTGATCATATATTTTTTATTTTTAT ATATGATCAATATATGTAC |
| SEQ ID NO: 164 | GATGTATATACTTTTTATTTTTTATATATATATTTTTATTTTTA TATATATAGTATATACATC |
| SEQ ID NO: 165 | GGTACATATATTTTTTATTTTTGATATATATATTTTTATTTTTA TATATATCATATATGTACC |
| SEQ ID NO: 166 | GGTACATATATTTTTTATTTTTGATATATGTATTTTTATTTTTA CATATATCATATATGTACC |
| SEQ ID NO: 167 | GGTACATATATTTTTTATTTTTGATCATGTATTTTTTATTTTTAT ACATGATCATATATGTACC |
| SEQ ID NO: 168 | GGTACATATATTTTTTATTTTTGATCATATATTTTTTATTTTTAT ATATGATCATATATGTACC |
| SEQ ID NO: 169 | CGATCATATATTTTTTATTTTTGATATATATATTTTTATTTTTT ATATATATCAATATATGATCG |
| SEQ ID NO: 170 | CGATCATATATTTTTTATTTTTGATATATGTATTTTTATTTTTT ACATATATCAATATATGATCG |
| SEQ ID NO: 171 | CGATCATATATTTTTTATTTTTGATCATGTATTTTTTATTTTTA TACATGATCAATATATGATCG |
| SEQ ID NO: 172 | CGATCATATATTTTTTATTTTTGATCATATATTTTTTATTTTTA TATATGATCAATATATGATCG |
| SEQ ID NO: 173 | GATACTTTTTATTTTTTATAAATATATATATTTTTTATTTTTATA TATATATATAGTATC |
| SEQ ID NO: 174 | GACACTTTTTATTTTTTATAAATATATATATTTTTTATTTTTATA TATATATATAGTGTC |
| SEQ ID NO: 175 | GATACTTTTTATTTTTGATAAATATATATATTTTTTATTTTTATA TATATATATCGTATC |
| SEQ ID NO: 176 | GATACTTTTTATTTTTGATAAATGTATATATTTTTTATTTTTATA TATACATATATCGTATC |
| SEQ ID NO: 177 | GATACTTTTTATTTTTGATGATGTATATATATTTTTATTTTTTAT ATATACATGATCGTATC |
| SEQ ID NO: 178 | GATACTTTTTATTTTTGATGATATATGTACTTTTTATTTTTAGT ACATATATGATCGTATC |
| SEQ ID NO: 179 | GGATCTTTTTATTTTTTATAAATATATATATTTTTTATTTTTATA TATATATATAGATCC |
| SEQ ID NO: 180 | GACACTTTTTATTTTTGATAAATATATATATTTTTTATTTTTATA TATATATATCGTGTC |
| SEQ ID NO: 181 | GACACTTTTTATTTTTGATAAATGTATATATTTTTTATTTTTATA TATACATATATCGTGTC |
| SEQ ID NO: 182 | GACACTTTTTATTTTTGATGATGTATATATATTTTTATTTTTTAT ATATACATGATCGTGTC |
| SEQ ID NO: 183 | GACACTTTTTATTTTTGATGATATATGTACTTTTTATTTTTAGT ACATATATGATCGTGTC |
| SEQ ID NO: 184 | GGATCTTTTTATTTTTGATAAATATATATATTTTTTATTTTTATA TATATATATCGATCC |
| SEQ ID NO: 185 | GGATCTTTTTATTTTTGATAAATGTATATATTTTTTATTTTTATA TATACATATATCGATCC |
| SEQ ID NO: 186 | GGATCTTTTTATTTTTGATGATGTATATATATTTTTATTTTTTAT ATATACATGATCGATCC |

TABLE 1-continued

Nucleotide sequences of blocked nucleic acid molecules.

| SEQ ID NO: | Sequence |
|---|---|
| SEQ ID NO: 187 | GGATCTTTTTATTTTTGATGATATATGTACTTTTTATTTTTAGTACATATATGATCGATCC |
| SEQ ID NO: 188 | GCGTCTTTTTATTTTTTATAAATATATATATTTTTATTTTTATATATATATATAGACGC |
| SEQ ID NO: 189 | GCGTCTTTTTATTTTTGATAAATATATATATTTTTATTTTTATATATATATATCGACGC |
| SEQ ID NO: 190 | GCGTCTTTTTATTTTTGATAAATGTATATATTTTTATTTTTATATACATATATCGACGC |
| SEQ ID NO: 191 | GCGTCTTTTTATTTTTGATGATGTATATATATTTTTATTTTTTATATATACATGATCGACGC |
| SEQ ID NO: 192 | GCGTCTTTTTATTTTTGATGATATATGTACTTTTTATTTTTAGTACATATATGATCGACGC |
| SEQ ID NO: 193 | GTATACTTTTTATTTTTGATAAATATATATATTTTTATTTTTTATATATATATATCGTATAC |
| SEQ ID NO: 194 | GTATACTTTTTATTTTTGATAAATGTATATATTTTTATTTTTTATATACATATATCGTATAC |
| SEQ ID NO: 195 | GTATACTTTTTATTTTTGATGATGTATATATTTTTATTTTTTATATATACATGATCGTATAC |
| SEQ ID NO: 196 | GTATACTTTTTATTTTTGATGATATATGTACTTTTTATTTTTGTACATATATGATCGTATAC |
| SEQ ID NO: 197 | GTGATCTTTTTATTTTTGATAAATATATATATTTTTATTTTTTATATATATATATCGATCAC |
| SEQ ID NO: 198 | GTGATCTTTTTATTTTTGATAAATGTATATATTTTTATTTTTTATATACATATATCGATCAC |
| SEQ ID NO: 199 | GTGATCTTTTTATTTTTGATGATGTATATATTTTTATTTTTTATATATACATGATCGATCAC |
| SEQ ID NO: 200 | GTGATCTTTTTATTTTTGATGATATATGTACTTTTTATTTTTGTACATATATGATCGATCAC |
| SEQ ID NO: 201 | GGATACTTTTTATTTTTGATAAATATATATATTTTTATTTTTTATATATATATATCGTATCC |
| SEQ ID NO: 202 | GGATACTTTTTATTTTTGATAAATGTATATATTTTTATTTTTTATATACATATATCGTATCC |
| SEQ ID NO: 203 | GGATACTTTTTATTTTTGATGATGTATATATTTTTATTTTTTATATATACATGATCGTATCC |
| SEQ ID NO: 204 | GGATACTTTTTATTTTTGATGATATATGTACTTTTTATTTTTGTACATATATGATCGTATCC |
| SEQ ID NO: 205 | GCGATCTTTTTATTTTTGATAAATATATATATTTTTATTTTTTATATATATATATCGATCGC |
| SEQ ID NO: 206 | GCGATCTTTTTATTTTTGATAAATGTATATATTTTTATTTTTTATATACATATATCGATCGC |
| SEQ ID NO: 207 | GCGATCTTTTTATTTTTGATGATGTATATATTTTTATTTTTTATATATACATGATCGATCGC |
| SEQ ID NO: 208 | GCGATCTTTTTATTTTTGATGATATATGTACTTTTTATTTTTGTACATATATGATCGATCGC |
| SEQ ID NO: 209 | GATATACTTTTTATTTTTTATAAATATATATTTTTATTTTTTATATATATATAGTATATC |
| SEQ ID NO: 210 | GATATATTTTTATTTTTGATAAATGTATATTTTTATTTTTTATATACATATATCATATATC |
| SEQ ID NO: 211 | GATATATTTTTATTTTTGATGATGTATATATTTTTATTTTTTATATACATGATCATATATC |

TABLE 1-continued

Nucleotide sequences of blocked nucleic acid molecules.

| SEQ ID NO: | Sequence |
|---|---|
| SEQ ID NO: 212 | GATATATTTTTATTTTTGATGATATATGTATTTTTATTTTTAC ATATATGATCATATATC |
| SEQ ID NO: 213 | GTGATACTTTTTATTTTTTATAAATATATATTTTTTATTTTTATA TATATATATAGTATCAC |
| SEQ ID NO: 214 | GATATACTTTTTATTTTTGATAAATATATATTTTTTATTTTTATA TATATATATCGTATATC |
| SEQ ID NO: 215 | GATATACTTTTTATTTTTGATGATGTATATATTTTTTATTTTTAT ATACATGATCGTATATC |
| SEQ ID NO: 216 | GATATACTTTTTATTTTTGATGATATATGTATTTTTATTTTTAC ATATATGATCGTATATC |
| SEQ ID NO: 217 | GGTATACTTTTTATTTTTTATAAATATATATTTTTTATTTTTATA TATATATATAGTATACC |
| SEQ ID NO: 218 | GTGATACTTTTTATTTTTGATAAATATATATTTTTTATTTTTATA TATATATATCGTATCAC |
| SEQ ID NO: 219 | GTGATACTTTTTATTTTTGATAAATGTATATTTTTTATTTTTATA TACATATATCGTATCAC |
| SEQ ID NO: 220 | GTGATACTTTTTATTTTTGATGATGTATATATTTTTTATTTTTAT ATACATGATCGTATCAC |
| SEQ ID NO: 221 | GTGATACTTTTTATTTTTGATGATATATGTATTTTTATTTTTAC ATATATGATCGTATCAC |
| SEQ ID NO: 222 | GGTATACTTTTTATTTTTGATAAATATATATTTTTTATTTTTATA TATATATATCGTATACC |
| SEQ ID NO: 223 | GGTATACTTTTTATTTTTGATAAATGTATATTTTTTATTTTTATA TACATATATCGTATACC |
| SEQ ID NO: 224 | GGTATACTTTTTATTTTTGATGATGTATATATTTTTTATTTTTAT ATACATGATCGTATACC |
| SEQ ID NO: 225 | GGTATACTTTTTATTTTTGATGATATATGTATTTTTATTTTTAC ATATATGATCGTATACC |
| SEQ ID NO: 226 | GGTGTACTTTTTATTTTTTATAAATATATATTTTTTATTTTTATA TATATATATAGTACACC |
| SEQ ID NO: 227 | GGTGTACTTTTTATTTTTGATAAATATATATTTTTTATTTTTATA TATATATATCGTACACC |
| SEQ ID NO: 228 | GGTGTACTTTTTATTTTTGATAAATGTATATTTTTTATTTTTATA TACATATATCGTACACC |
| SEQ ID NO: 229 | GGTGTACTTTTTATTTTTGATGATGTATATATTTTTTATTTTTAT ATACATGATCGTACACC |
| SEQ ID NO: 230 | GGTGTACTTTTTATTTTTGATGATATATGTATTTTTATTTTTAC ATATATGATCGTACACC |
| SEQ ID NO: 231 | GTATACTTTTTATTTTTTGATAAATATATATTTTTTATTTTTTAT ATATATATCGTATATAC |
| SEQ ID NO: 232 | GTATACTTTTTATTTTTGATAAATGTATATTTTTTATTTTTTAT ACATATATCGTATATAC |
| SEQ ID NO: 233 | GTATACTTTTTATTTTTGATGATGTATATTTTTTATTTTTTATA TACATGATCGTATATAC |
| SEQ ID NO: 234 | GTATACTTTTTATTTTTGATGATATATGTTTTTTATTTTTACA TATATGATCGTATATAC |
| SEQ ID NO: 235 | GGATATACTTTTTATTTTTGATAAATATATATTTTTTATTTTTTAT ATATATATCGTATATCC |
| SEQ ID NO: 236 | GGATATACTTTTTATTTTTGATAAATGTATATTTTTTATTTTTTAT ACATATATCGTATATCC |

TABLE 1-continued

Nucleotide sequences of blocked nucleic acid molecules.

| SEQ ID NO: | Sequence |
| --- | --- |
| SEQ ID NO: 237 | GGATATACTTTTTATTTTTGATGATGTATATTTTTATTTTTATA<br>TACATGATCGTATATCC |
| SEQ ID NO: 238 | GGATATACTTTTTATTTTTGATGATATATGTTTTTATTTTTACA<br>TATATGATCGTATATCC |
| SEQ ID NO: 239 | GGTGATACTTTTTATTTTTGATAAATATATATTTTTATTTTTAT<br>ATATATATCGTATCACC |
| SEQ ID NO: 240 | GGTGATACTTTTTATTTTTGATAAATGTATATTTTTATTTTTAT<br>ACATATATCGTATCACC |
| SEQ ID NO: 241 | GGTGATACTTTTTATTTTTGATGATGTATATTTTTATTTTTATA<br>TACATGATCGTATCACC |
| SEQ ID NO: 242 | GGTGATACTTTTTATTTTTGATGATATATGTTTTTATTTTTACA<br>TATATGATCGTATCACC |
| SEQ ID NO: 243 | GGTGATCCTTTTTATTTTTGATAAATATATATTTTTATTTTTAT<br>ATATATATCGGATCACC |
| SEQ ID NO: 244 | GGTGATCCTTTTTATTTTTGATAAATGTATATTTTTATTTTTAT<br>ACATATATCGGATCACC |
| SEQ ID NO: 245 | GGTGATCCTTTTTATTTTTGATGATGTATATTTTTATTTTTATA<br>TACATGATCGGATCACC |
| SEQ ID NO: 246 | GGTGATCCTTTTTATTTTTGATGATATATGTTTTTATTTTTACA<br>TATATGATCGGATCACC |
| SEQ ID NO: 247 | GTATATACATTTTTATTTTTGATAAATATATTTTTATTTTTAT<br>ATATATCATGTATATAC |
| SEQ ID NO: 248 | GTATATACATTTTTATTTTTGATAAATGTATTTTTATTTTTAC<br>ATATATCATGTATATAC |
| SEQ ID NO: 249 | GTATATACATTTTTATTTTTGATGATGTATTTTTATTTTTATA<br>CATGATCATGTATATAC |
| SEQ ID NO: 250 | GTATATACATTTTTATTTTTGATGATATATTTTTATTTTTATA<br>TATGATCATGTATATAC |
| SEQ ID NO: 251 | GGATATACATTTTTATTTTTGATAAATATATTTTTATTTTTAT<br>ATATATCATGTATATCC |
| SEQ ID NO: 252 | GGATATACATTTTTATTTTTGATAAATGTATTTTTATTTTTAC<br>ATATATCATGTATATCC |
| SEQ ID NO: 253 | GGATATACATTTTTATTTTTGATGATGTATTTTTATTTTTATA<br>CATGATCATGTATATCC |
| SEQ ID NO: 254 | GGATATACATTTTTATTTTTGATGATATATTTTTATTTTTATA<br>TATGATCATGTATATCC |
| SEQ ID NO: 255 | GGATATACACTTTTTATTTTTGATAAATATATATTTTTATTTTTAT<br>ATATATCGTGTATATCC |
| SEQ ID NO: 256 | GGATATACACTTTTTATTTTTGATAAATGTATATTTTTATTTTTAC<br>ATATATCGTGTATATCC |
| SEQ ID NO: 257 | GGATATACACTTTTTATTTTTGATGATGTATATTTTTATTTTTATA<br>CATGATCGTGTATATCC |
| SEQ ID NO: 258 | GGATATACACTTTTTATTTTTGATGATATATTTTTATTTTTATA<br>TATGATCGTGTATATCC |
| SEQ ID NO: 259 | GGGTATATACTTTTTATTTTTGATAAATATATATTTTTATTTTTAT<br>ATATATCGTATATACCC |
| SEQ ID NO: 260 | GGGTATATACTTTTTATTTTTGATAAATGTATATTTTTATTTTTAC<br>ATATATCGTATATACCC |
| SEQ ID NO: 261 | GGGTATATACTTTTTATTTTTGATGATGTATATTTTTATTTTTATA<br>CATGATCGTATATACCC |

TABLE 1-continued

Nucleotide sequences of blocked nucleic acid molecules.

| SEQ ID NO: | Sequence |
| --- | --- |
| SEQ ID NO: 262 | GGGTATATACTTTTTATTTTTGATGATATATTTTTATTTTTATA TATGATCGTATATACCC |
| SEQ ID NO: 263 | GGATGTACACTTTTTATTTTTGATAAATATATTTTTATTTTTAT ATATATCGTGTACATCC |
| SEQ ID NO: 264 | GGATGTACACTTTTTATTTTTGATAAATGTATTTTTATTTTTAC ATATATCGTGTACATCC |
| SEQ ID NO: 265 | GGATGTACACTTTTTATTTTTGATGATGTATTTTTATTTTTATA CATGATCGTGTACATCC |
| SEQ ID NO: 266 | GGATGTACACTTTTTATTTTTGATGATATATTTTTATTTTTATA TATGATCGTGTACATCC |
| SEQ ID NO: 267 | GTATATACTTTTTATTTTTTATAAATATATATATTTTTATTTTT ATATATATATATAGTATATAC |
| SEQ ID NO: 268 | GTATATACTTTTTATTTTTGATAAATATATATATTTTTATTTTT ATATATATATATCGTATATAC |
| SEQ ID NO: 269 | GTATATACTTTTTATTTTTGATAAATGTATATATTTTTATTTTT ATATATACATATCGTATATAC |
| SEQ ID NO: 270 | GTATATACTTTTTATTTTTGATGATGTATATATATTTTTATTTTT TATATATACATGATCGTATATAC |
| SEQ ID NO: 271 | GTATATACTTTTTATTTTTGATGATATATGTACTTTTTATTTTT AGTACATATATGATCGTATATAC |
| SEQ ID NO: 272 | GGATATACTTTTTATTTTTTATAAATATATATATTTTTATTTTT ATATATATATATAGTATATCC |
| SEQ ID NO: 273 | GGATATACTTTTTATTTTTGATAAATATATATATTTTTATTTTT ATATATATATATCGTATATCC |
| SEQ ID NO: 274 | GGATATACTTTTTATTTTTGATAAATGTATATATTTTTATTTTT ATATATACATATCGTATATCC |
| SEQ ID NO: 275 | GGATATACTTTTTATTTTTGATGATGTATATATATTTTTATTTTT TATATATACATGATCGTATATCC |
| SEQ ID NO: 276 | GGATATACTTTTTATTTTTGATGATATATGTACTTTTTATTTTT AGTACATATATGATCGTATATCC |
| SEQ ID NO: 277 | GGTGATACTTTTTATTTTTTATAAATATATATATTTTTATTTTT ATATATATATATAGTATCACC |
| SEQ ID NO: 278 | GGTGATACTTTTTATTTTTGATAAATATATATATTTTTATTTTT ATATATATATATCGTATCACC |
| SEQ ID NO: 279 | GGTGATACTTTTTATTTTTGATAAATGTATATATTTTTATTTTT ATATATACATATCGTATCACC |
| SEQ ID NO: 280 | GGTGATACTTTTTATTTTTGATGATGTATATATATTTTTATTTTT TATATATACATGATCGTATCACC |
| SEQ ID NO: 281 | GGTGATACTTTTTATTTTTGATGATATATGTACTTTTTATTTTT AGTACATATATGATCGTATCACC |
| SEQ ID NO: 282 | GGTGATCCTTTTTATTTTTTATAAATATATATATTTTTATTTTT ATATATATATATAGGATCACC |
| SEQ ID NO: 283 | GGTGATCCTTTTTATTTTTGATAAATATATATATTTTTATTTTT ATATATATATATCGGATCACC |
| SEQ ID NO: 284 | GGTGATCCTTTTTATTTTTGATAAATGTATATATTTTTATTTTT ATATATACATATCGGATCACC |
| SEQ ID NO: 285 | GGTGATCCTTTTTATTTTTGATGATGTATATATATTTTTATTTTT TATATATACATGATCGGATCACC |
| SEQ ID NO: 286 | GGTGATCCTTTTTATTTTTGATGATATATGTACTTTTTATTTTT AGTACATATATGATCGGATCACC |

TABLE 1-continued

Nucleotide sequences of blocked nucleic acid molecules.

| SEQ ID NO: | Sequence |
| --- | --- |
| SEQ ID NO: 287 | GATATATCACTTTTTATTTTTATAAATATATATATTTTTTATTT<br>TTATATATATATATATAGTGATATATC |
| SEQ ID NO: 288 | GTATATACATTTTTTATTTTTGATAAATATATATATTTTTTATTT<br>TTATATATATATATATCATGTATATAC |
| SEQ ID NO: 289 | GTATATACATTTTTTATTTTTGATAAATGTATATATTTTTTATTT<br>TTATATATACATATATCATGTATATAC |
| SEQ ID NO: 290 | GTATATACATTTTTTATTTTTGATGATGTATATATATTTTTTATTT<br>TTTATATATACATGATCATGTATATAC |
| SEQ ID NO: 291 | GTATATACATTTTTTATTTTTGATGATATATGTACTTTTTTATTT<br>TTAGTACATATATGATCATGTATATAC |
| SEQ ID NO: 292 | GGATATACACTTTTTATTTTTTATAAATATATATATTTTTTATTT<br>TTATATATATATATATAGTGTATATCC |
| SEQ ID NO: 293 | GGATATACATTTTTTATTTTTGATAAATATATATATTTTTTATTT<br>TTATATATATATATATCATGTATATCC |
| SEQ ID NO: 294 | GGATATACATTTTTTATTTTTGATAAATGTATATATTTTTTATTT<br>TTATATATACATATATCATGTATATCC |
| SEQ ID NO: 295 | GGATATACATTTTTTATTTTTGATGATGTATATATATTTTTTATTT<br>TTTATATATACATGATCATGTATATCC |
| SEQ ID NO: 296 | GGATATACATTTTTTATTTTTGATGATATATGTACTTTTTTATTT<br>TTAGTACATATATGATCATGTATATCC |
| SEQ ID NO: 297 | GGGTATATACTTTTTTATTTTTTATAAATATATATATTTTTTATTT<br>TTATATATATATATATAGTATATACCC |
| SEQ ID NO: 298 | GGATATACACTTTTTATTTTTGATAAATATATATATTTTTTATT<br>TTTATATATATATATATCGTGTATATCC |
| SEQ ID NO: 299 | GGATATACACTTTTTATTTTTGATAAATGTATATATTTTTTATT<br>TTTATATATACATATATCGTGTATATCC |
| SEQ ID NO: 300 | GGATATACACTTTTTATTTTTGATGATGTATATATATTTTTTATT<br>TTTTATATATACATGATCGTGTATATCC |
| SEQ ID NO: 301 | GGATATACACTTTTTATTTTTGATGATATATGTACTTTTTTATTT<br>TTAGTACATATATGATCGTGTATATCC |
| SEQ ID NO: 302 | GGGTATATACTTTTTATTTTTGATAAATATATATATTTTTTATTT<br>TTATATATATATATATCGTATATACCC |
| SEQ ID NO: 303 | GGGTATATACTTTTTATTTTTGATAAATGTATATATTTTTTATTT<br>TTATATATACATATATCGTATATACCC |
| SEQ ID NO: 304 | GGGTATATACTTTTTATTTTTGATGATGTATATATATTTTTTATTT<br>TTTATATATACATGATCGTATATACCC |
| SEQ ID NO: 305 | GGGTATATACTTTTTATTTTTGATGATATATGTACTTTTTTATTT<br>TTAGTACATATATGATCGTATATACCC |
| SEQ ID NO: 306 | GTATATACTTTTTATTTTTGATAAATATATATATTTTTATTTTTT<br>ATATATATATATCGTATATAC |
| SEQ ID NO: 307 | GTATATACTTTTTATTTTTGATAAATGTATATATTTTTATTTTTT<br>ATATACATATATCGTATATAC |
| SEQ ID NO: 308 | GTATATACTTTTTATTTTTGATGATGTATATATATTTTTATTTTTA<br>TATATACATGATCGTATATAC |
| SEQ ID NO: 309 | GTATATACTTTTTATTTTTGATGATATATGTACTTTTTATTTTTG<br>TACATATATGATCGTATATAC |
| SEQ ID NO: 310 | GGATATACTTTTTATTTTTGATAAATATATATATTTTTATTTTTT<br>ATATATATATATCGTATATCC |
| SEQ ID NO: 311 | GGATATACTTTTTATTTTTGATAAATGTATATATTTTTATTTTTT<br>ATATACATATATCGTATATCC |

TABLE 1-continued

Nucleotide sequences of blocked nucleic acid molecules.

| SEQ ID NO: | Sequence |
|---|---|
| SEQ ID NO: 312 | GGATATACTTTTTATTTTTGATGATGTATATATTTTTATTTTTA TATATACATGATCGTATATCC |
| SEQ ID NO: 313 | GGATATACTTTTTATTTTTGATGATATATGTACTTTTTATTTTTG TACATATATGATCGTATATCC |
| SEQ ID NO: 314 | GGTGATACTTTTTATTTTTGATAAATATATATATTTTTATTTTTT ATATATATATCGTATCACC |
| SEQ ID NO: 315 | GGTGATACTTTTTATTTTTGATAAATGTATATATTTTTATTTTTT ATACATATATCGTATCACC |
| SEQ ID NO: 316 | GGTGATACTTTTTATTTTTGATGATGTATATATTTTTATTTTTA TATATACATGATCGTATCACC |
| SEQ ID NO: 317 | GGTGATACTTTTTATTTTTGATGATATATGTACTTTTTATTTTTG TACATATATGATCGTATCACC |
| SEQ ID NO: 318 | GGTGATCCTTTTTATTTTTGATAAATATATATATTTTTATTTTTT ATATATATATCGGATCACC |
| SEQ ID NO: 319 | GGTGATCCTTTTTATTTTTGATAAATGTATATATTTTTATTTTTT ATACATATATCGGATCACC |
| SEQ ID NO: 320 | GGTGATCCTTTTTATTTTTGATGATGTATATATTTTTATTTTTA TATATACATGATCGGATCACC |
| SEQ ID NO: 321 | GGTGATCCTTTTTATTTTTGATGATATATGTACTTTTTATTTTTG TACATATATGATCGGATCACC |
| SEQ ID NO: 322 | GTATATACATTTTTATTTTTGATAAATATATATATTTTTATTTT TTATATATATATCATGTATATAC |
| SEQ ID NO: 323 | GTATATACATTTTTATTTTTGATGATGTATATATTTTTATTTT TATATATACATGATCATGTATATAC |
| SEQ ID NO: 324 | GTATATACATTTTTATTTTTGATGATATATGTACTTTTTATTTT TGTACATATATGATCATGTATATAC |
| SEQ ID NO: 325 | GGATATACATTTTTATTTTTGATAAATATATATATTTTTATTTT TTATATATATATCATGTATATCC |
| SEQ ID NO: 326 | GGATATACATTTTTATTTTTGATAAATGTATATATTTTTATTTT TTATACATATATCATGTATATCC |
| SEQ ID NO: 327 | GGATATACATTTTTATTTTTGATGATGTATATATTTTTATTTT TATATACATGATCATGTATATCC |
| SEQ ID NO: 328 | GGATATACATTTTTATTTTTGATGATATATGTACTTTTTATTTT TGTACATATATGATCATGTATATCC |
| SEQ ID NO: 329 | GGATATACACTTTTTATTTTTGATAAATATATATATTTTTATTT TTTATATATATATCGTGTATATCC |
| SEQ ID NO: 330 | GGATATACACTTTTTATTTTTGATAAATGTATATATTTTTATTT TTTATACATATATCGTGTATATCC |
| SEQ ID NO: 331 | GGATATACACTTTTTATTTTTGATGATGTATATATTTTTATTTT TATATATACATGATCGTGTATATCC |
| SEQ ID NO: 332 | GGATATACACTTTTTATTTTTGATGATATATGTACTTTTTATTTT TGTACATATATGATCGTGTATATCC |
| SEQ ID NO: 333 | GGGTATATACTTTTTATTTTTGATAAATATATATATTTTTATTTT TTATATATATATCGTATATACCC |
| SEQ ID NO: 334 | GGGTATATACTTTTTATTTTTGATAAATGTATATATTTTTATTTT TTATACATATATCGTATATACCC |
| SEQ ID NO: 335 | GGGTATATACTTTTTATTTTTGATGATGTATATATTTTTATTTT TATATATACATGATCGTATATACCC |
| SEQ ID NO: 336 | GGGTATATACTTTTTATTTTTGATGATATATGTACTTTTTATTTT TGTACATATATGATCGTATATACCC |

TABLE 1-continued

Nucleotide sequences of blocked nucleic acid molecules.

| SEQ ID NO: | Sequence |
| --- | --- |
| SEQ ID NO: 337 | GATATATCACTTTTTATTTTTTATAAATATATATTTTTTATTTTT ATATATATATATAGTGATATATC |
| SEQ ID NO: 338 | GTATATACATTTTTTATTTTTGATAAATATATATTTTTTATTTTT ATATATATATATCATGTATATAC |
| SEQ ID NO: 339 | GTATATACATTTTTTATTTTTGATGATGTATATATTTTTATTTTT TATATACATGATCATGTATATAC |
| SEQ ID NO: 340 | GTATATACATTTTTTATTTTTGATGATATATGTATTTTTATTTTT TACATATATGATCATGTATATAC |
| SEQ ID NO: 341 | GGATATACACTTTTTATTTTTTATAAATATATATTTTTTATTTTT ATATATATATATAGTGTATATCC |
| SEQ ID NO: 342 | GGATATACATTTTTTATTTTTGATAAATATATATTTTTTATTTTT ATATATATATATCATGTATATCC |
| SEQ ID NO: 343 | GGATATACATTTTTTATTTTTGATAAATGTATATTTTTTATTTTT ATATACATATATCATGTATATCC |
| SEQ ID NO: 344 | GGATATACATTTTTTATTTTTGATGATGTATATATTTTTATTTTT TATATACATGATCATGTATATCC |
| SEQ ID NO: 345 | GGATATACATTTTTTATTTTTGATGATATATGTATTTTTATTTTT TACATATATGATCATGTATATCC |
| SEQ ID NO: 346 | GGGTATATACTTTTTATTTTTTATAAATATATATTTTTTATTTTT ATATATATATAGTATATACCC |
| SEQ ID NO: 347 | GGATATACACTTTTTATTTTTGATAAATATATATTTTTTATTTTT ATATATATATATCGTGTATATCC |
| SEQ ID NO: 348 | GGATATACACTTTTTATTTTTGATAAATGTATATTTTTTATTTTT ATATACATATATCGTGTATATCC |
| SEQ ID NO: 349 | GGATATACACTTTTTATTTTTGATGATGTATATATTTTTATTTTT TATATACATGATCGTGTATATCC |
| SEQ ID NO: 350 | GGATATACACTTTTTATTTTTGATGATATATGTATTTTTATTTTT TACATATATGATCGTGTATATCC |
| SEQ ID NO: 351 | GGGTATATACTTTTTATTTTTGATAAATATATATTTTTTATTTTT ATATATATATCGTATATACCC |
| SEQ ID NO: 352 | GGGTATATACTTTTTATTTTTGATAAATGTATATTTTTTATTTTT ATATACATATATCGTATATACCC |
| SEQ ID NO: 353 | GGGTATATACTTTTTATTTTTGATGATGTATATATTTTTATTTTT TATATACATGATCGTATATACCC |
| SEQ ID NO: 354 | GGGTATATACTTTTTATTTTTGATGATATATGTATTTTTATTTTT TACATATATGATCGTATATACCC |
| SEQ ID NO: 355 | GTATATACATTTTTTATTTTTGATAAATATATATTTTTTATTTTT ATATATATATCATGTATATAC |
| SEQ ID NO: 356 | GTATATACATTTTTTATTTTTGATGATGTATATTTTTTATTTTTA TATACATGATCATGTATATAC |
| SEQ ID NO: 357 | GTATATACATTTTTTATTTTTGATGATATATGTTTTTTATTTTTA CATATATGATCATGTATATAC |
| SEQ ID NO: 358 | GGATATACATTTTTTATTTTTGATAAATATATATTTTTTATTTTT ATATATATATCATGTATATCC |
| SEQ ID NO: 359 | GGATATACATTTTTTATTTTTGATAAATGTATATTTTTTATTTTT ATACATATATCATGTATATCC |
| SEQ ID NO: 360 | GGATATACATTTTTTATTTTTGATGATGTATATTTTTTATTTTTA TATACATGATCATGTATATCC |
| SEQ ID NO: 361 | GGATATACATTTTTTATTTTTGATGATATATGTTTTTTATTTTTA CATATATGATCATGTATATCC |

TABLE 1-continued

Nucleotide sequences of blocked nucleic acid molecules.

| SEQ ID NO: | Sequence |
|---|---|
| SEQ ID NO: 362 | GGATATACACTTTTTATTTTTGATAAATATATATTTTTATTTTTT ATATATATATCGTGTATATCC |
| SEQ ID NO: 363 | GGATATACACTTTTTATTTTTGATAAATGTATATTTTTATTTTTT ATACATATATCGTGTATATCC |
| SEQ ID NO: 364 | GGATATACACTTTTTATTTTTGATGATGTATATTTTTTATTTTTA TATACATGATCGTGTATATCC |
| SEQ ID NO: 365 | GGATATACACTTTTTATTTTTGATGATATATGTTTTTTATTTTTA CATATATGATCGTGTATATCC |
| SEQ ID NO: 366 | GGGTATATACTTTTTATTTTTGATAAATATATATTTTTATTTTTT ATATATATCGTATATACCC |
| SEQ ID NO: 367 | GGGTATATACTTTTTATTTTTGATAAATGTATATTTTTATTTTTT ATACATATATCGTATATACCC |
| SEQ ID NO: 368 | GGGTATATACTTTTTATTTTTGATGATGTATATTTTTTATTTTTA TATACATGATCGTATATACCC |
| SEQ ID NO: 369 | GGGTATATACTTTTTATTTTTGATGATATATGTTTTTTATTTTTA CATATATGATCGTATATACCC |
| SEQ ID NO: 370 | GTACATATATTTTTTATTTTTGATAAATATATTTTTATTTTTTA TATATATCAATATATGTAC |
| SEQ ID NO: 371 | GTACATATATTTTTTATTTTTGATAAATGTATTTTTATTTTTTA CATATATCAATATATGTAC |
| SEQ ID NO: 372 | GTACATATATTTTTTATTTTTGATGATGTATTTTTTATTTTTAT ACATGATCAATATATGTAC |
| SEQ ID NO: 373 | GTACATATATTTTTTATTTTTGATGATATATTTTTTATTTTTAT ATATGATCAATATATGTAC |
| SEQ ID NO: 374 | GGTACATATATTTTTTATTTTTGATAAATATATTTTTATTTTTTA TATATCATATATGTACC |
| SEQ ID NO: 375 | GGTACATATATTTTTTATTTTTGATAAATGTATTTTTATTTTTTA CATATATCATATATGTACC |
| SEQ ID NO: 376 | GGTACATATATTTTTTATTTTTGATGATGTATTTTTTATTTTTAT ACATGATCATATATGTACC |
| SEQ ID NO: 377 | GGTACATATATTTTTTATTTTTGATGATATATTTTTTATTTTTAT ATATGATCATATATGTACC |
| SEQ ID NO: 378 | CGATCATATATTTTTTATTTTTGATAAATATATTTTTATTTTTT ATATATATCAATATATGATCG |
| SEQ ID NO: 379 | CGATCATATATTTTTTATTTTTGATAAATGTATTTTTATTTTTT ACATATATCAATATATGATCG |
| SEQ ID NO: 380 | CGATCATATATTTTTTATTTTTGATGATGTATTTTTTATTTTTA TACATGATCAATATATGATCG |
| SEQ ID NO: 381 | CGATCATATATTTTTTATTTTTGATGATATATTTTTTATTTTTA TATATGATCAATATATGATCG |
| SEQ ID NO: 382 | GTATATACTTTTTATTTTTGATGATGTAAATATATTTTTATTTTT TATATATACATGATCGTATATAC |
| SEQ ID NO: 383 | GTATATACTTTTTATTTTTGATGATATAAGTACTTTTTATTTTTT AGTACATATATGATCGTATATAC |
| SEQ ID NO: 384 | GGATATACTTTTTATTTTTGATGATGTAAATATATTTTTATTTTT TATATATACATGATCGTATATCC |
| SEQ ID NO: 385 | GGATATACTTTTTATTTTTGATGATATAAGTACTTTTTATTTTTT AGTACATATATGATCGTATATCC |
| SEQ ID NO: 386 | GGTGATACTTTTTATTTTTGATGATGTAAATATATTTTTATTTTT TATATATACATGATCGTATCACC |

TABLE 1-continued

Nucleotide sequences of blocked nucleic acid molecules.

| SEQ ID NO: | Sequence |
| --- | --- |
| SEQ ID NO: 387 | GGTGATACTTTTTATTTTTGATGATATAAGTACTTTTTTATTTTT<br>AGTACATATATGATCGTATCACC |
| SEQ ID NO: 388 | GGTGATCCTTTTTATTTTTGATGATGTAAATATATTTTTATTTTT<br>TATATATACATGATCGGATCACC |
| SEQ ID NO: 389 | GGTGATCCTTTTTATTTTTGATGATATAAGTACTTTTTTATTTTT<br>AGTACATATATGATCGGATCACC |
| SEQ ID NO: 390 | GTATATACATTTTTTATTTTTGATGATGTAAATATATTTTTATTT<br>TTTATATATACATGATCATGTATATAC |
| SEQ ID NO: 391 | GTATATACATTTTTTATTTTTGATGATATAAGTACTTTTTTATTT<br>TTAGTACATATATGATCATGTATATAC |
| SEQ ID NO: 392 | GGATATACATTTTTTATTTTTGATAAATGTAAATATTTTTTATT<br>TTTATATATACATATATCATGTATATCC |
| SEQ ID NO: 393 | GGATATACATTTTTTATTTTTGATGATGTAAATATATTTTTATT<br>TTTTATATATACATGATCATGTATATCC |
| SEQ ID NO: 394 | GGATATACATTTTTTATTTTTGATGATATAAGTACTTTTTTATT<br>TTTAGTACATATATGATCATGTATATCC |
| SEQ ID NO: 395 | GGATATACACTTTTTATTTTTGATGATGTAAATATATTTTTATT<br>TTTTATATATACATGATCGTGTATATCC |
| SEQ ID NO: 396 | GGATATACACTTTTTATTTTTGATGATATAAGTACTTTTTTATT<br>TTTAGTACATATATGATCGTGTATATCC |
| SEQ ID NO: 397 | GGGTATATACTTTTTATTTTTGATGATGTAAATATATTTTTATT<br>TTTTATATATACATGATCGTATATACCC |
| SEQ ID NO: 398 | GGGTATATACTTTTTATTTTTGATGATATAAGTACTTTTTTATT<br>TTTAGTACATATATGATCGTATATACCC |
| SEQ ID NO: 399 | GTATATACTTTTTATTTTTGATGATGTAAATATTTTTTATTTTTA<br>TATATACATGATCGTATATAC |
| SEQ ID NO: 400 | GTATATACTTTTTATTTTTGATGATATAAGTACTTTTTATTTTTG<br>TACATATATGATCGTATATAC |
| SEQ ID NO: 401 | GGATATACTTTTTATTTTTGATGATGTAAATATTTTTTATTTTTA<br>TATATACATGATCGTATATCC |
| SEQ ID NO: 402 | GGATATACTTTTTATTTTTGATGATATAAGTACTTTTTATTTTT<br>GTACATATATGATCGTATATCC |
| SEQ ID NO: 403 | GGTGATACTTTTTATTTTTGATGATGTAAATATTTTTTATTTTTA<br>TATATACATGATCGTATCACC |
| SEQ ID NO: 404 | GGTGATACTTTTTATTTTTGATGATATAAGTACTTTTTATTTTT<br>GTACATATATGATCGTATCACC |
| SEQ ID NO: 405 | GGTGATCCTTTTTATTTTTGATGATGTAAATATTTTTTATTTTTA<br>TATATACATGATCGGATCACC |
| SEQ ID NO: 406 | GGTGATCCTTTTTATTTTTGATGATATAAGTACTTTTTATTTTTG<br>TACATATATGATCGGATCACC |
| SEQ ID NO: 407 | GTATATACATTTTTTATTTTTGATGATGTAAATATTTTTTATTTT<br>TATATATACATGATCATGTATATAC |
| SEQ ID NO: 408 | GTATATACATTTTTTATTTTTGATGATATAAGTACTTTTTATTTT<br>TGTACATATATGATCATGTATATAC |
| SEQ ID NO: 409 | GGATATACATTTTTTATTTTTGATGATGTAAATATTTTTTATTTT<br>TATATATACATGATCATGTATATCC |
| SEQ ID NO: 410 | GGATATACATTTTTTATTTTTGATGATATAAGTACTTTTTATTT<br>TTGTACATATATGATCATGTATATCC |
| SEQ ID NO: 411 | GGATATACACTTTTTATTTTTGATGATGTAAATATTTTTTATTT<br>TTATATATACATGATCGTGTATATCC |

TABLE 1-continued

Nucleotide sequences of blocked nucleic acid molecules.

| SEQ ID NO: | Sequence |
| --- | --- |
| SEQ ID NO: 412 | GGATATACACTTTTTATTTTTGATGATATAAGTACTTTTTATTT TTGTACATATATGATCGTGTATATCC |
| SEQ ID NO: 413 | GGGTATATACTTTTTATTTTTGATGATGTAAATATTTTTATTTT TATATATACATGATCGTATATACCC |
| SEQ ID NO: 414 | GGGTATATACTTTTTATTTTTGATGATATAAGTACTTTTTATTT TTGTACATATATGATCGTATATACCC |
| SEQ ID NO: 415 | GTATATACATTTTTATTTTTGATGATATAAGTATTTTTATTTTT TACATATATGATCATGTATATAC |
| SEQ ID NO: 416 | GGATATACATTTTTATTTTTGATAAATGAATATTTTTATTTTT ATATACATATATCATGTATATCC |
| SEQ ID NO: 417 | GGATATACATTTTTATTTTTGATGATATAAGTATTTTTATTTTT TACATATATGATCATGTATATCC |
| SEQ ID NO: 418 | GGATATACACTTTTTATTTTTGATAAATGAATATTTTTATTTT TATATACATATATCGTGTATATCC |
| SEQ ID NO: 419 | GGATATACACTTTTTATTTTTGATGATATAAGTATTTTTATTTT TTACATATATGATCGTGTATATCC |
| SEQ ID NO: 420 | GGGTATATACTTTTTATTTTTGATAAATGAATATTTTTATTTTT ATATACATATATCGTATATACCC |
| SEQ ID NO: 421 | GGGTATATACTTTTTATTTTTGATGATATAAGTATTTTTATTTTT TACATATATGATCGTATATACCC |
| SEQ ID NO: 422 | GTATATACATTTTTATTTTTGATGATGAATATTTTTATTTTTA TATACATGATCATGTATATAC |
| SEQ ID NO: 423 | GGATATACATTTTTATTTTTGATAAATGAATATTTTTATTTTT ATACATATATCATGTATATCC |
| SEQ ID NO: 424 | GGATATACATTTTTATTTTTGATGATGAATATTTTTATTTTTA TATACATGATCATGTATATCC |
| SEQ ID NO: 425 | GGATATACATTTTTATTTTTGATGATAAATGTTTTTATTTTTA CATATATGATCATGTATATCC |
| SEQ ID NO: 426 | GGATATACACTTTTTATTTTTGATGATGAATATTTTTATTTTT ATATACATGATCGTGTATATCC |
| SEQ ID NO: 427 | GGGTATATACTTTTTATTTTTGATGATGAATATTTTTATTTTTA TATACATGATCGTATATACCC |
| SEQ ID NO: 428 | GATACTTTTTATTTTTGATGATGTAAATATATTTTTATTTTTTAT ATATACATGATCGTATC |
| SEQ ID NO: 429 | GATACTTTTTATTTTTGATGATATAAGTACTTTTTATTTTTAGT ACATATATGATCGTATC |
| SEQ ID NO: 430 | GACACTTTTTATTTTTGATGATGTAAATATATTTTTATTTTTTAT ATATACATGATCGTGTC |
| SEQ ID NO: 431 | GACACTTTTTATTTTTGATGATATAAGTACTTTTTATTTTTAGT ACATATATGATCGTGTC |
| SEQ ID NO: 432 | GGATCTTTTTATTTTTGATGATGTAAATATATTTTTATTTTTTAT ATATACATGATCGATCC |
| SEQ ID NO: 433 | GGATCTTTTTATTTTTGATGATATAAGTACTTTTTATTTTTAGT ACATATATGATCGATCC |
| SEQ ID NO: 434 | GCGTCTTTTTATTTTTGATGATGTAAATATATTTTTATTTTTTAT ATATACATGATCGACGC |
| SEQ ID NO: 435 | GCGTCTTTTTATTTTTGATGATATAAGTACTTTTTATTTTTAGT ACATATATGATCGACGC |
| SEQ ID NO: 436 | GTATCTTTTTATTTTTGATGATGTAAATATTTTTTATTTTTATA TATACATGATCGTATAC |

TABLE 1-continued

Nucleotide sequences of blocked nucleic acid molecules.

| SEQ ID NO: | Sequence |
|---|---|
| SEQ ID NO: 437 | GTATACTTTTTATTTTTGATGATATAAGTACTTTTTATTTTTGTA<br>CATATATGATCGTATAC |
| SEQ ID NO: 438 | GTGATCTTTTTATTTTTGATGATGTAAATATTTTTATTTTTATA<br>TATACATGATCGATCAC |
| SEQ ID NO: 439 | GTGATCTTTTTATTTTTGATGATATAAGTACTTTTTATTTTTGTA<br>CATATATGATCGATCAC |
| SEQ ID NO: 440 | GGATACTTTTTATTTTTGATGATGTAAATATTTTTATTTTTATA<br>TATACATGATCGTATCC |
| SEQ ID NO: 441 | GGATACTTTTTATTTTTGATGATATAAGTACTTTTTATTTTTGT<br>ACATATATGATCGTATCC |
| SEQ ID NO: 442 | GCGATCTTTTTATTTTTGATGATGTAAATATTTTTATTTTTATA<br>TATACATGATCGATCGC |
| SEQ ID NO: 443 | GCGATCTTTTTATTTTTGATGATATAAGTACTTTTTATTTTTGTA<br>CATATATGATCGATCGC |
| SEQ ID NO: 444 | GATATATTTTTATTTTTGATGATATAAGTATTTTTATTTTTAC<br>ATATATGATCATATATC |
| SEQ ID NO: 445 | GATATACTTTTTATTTTTGATGATATAAGTATTTTTATTTTTAC<br>ATATATGATCGTATATC |
| SEQ ID NO: 446 | GTGATACTTTTTATTTTTGATAAATGAATATTTTTATTTTTATA<br>TACATATATCGTATCAC |
| SEQ ID NO: 447 | GTGATACTTTTTATTTTTGATGATATAAGTATTTTTATTTTTAC<br>ATATATGATCGTATCAC |
| SEQ ID NO: 448 | GGTACTTTTTATTTTTGATAAATGAATATTTTTATTTTTATA<br>TACATATATCGTATACC |
| SEQ ID NO: 449 | GGTATACTTTTTATTTTTGATGATATAAGTATTTTTATTTTTAC<br>ATATATGATCGTATACC |
| SEQ ID NO: 450 | GGTGTACTTTTTATTTTTGATAAATGAATATTTTTATTTTTATA<br>TACATATATCGTACACC |
| SEQ ID NO: 451 | GGTGTACTTTTTATTTTTGATGATATAAGTATTTTTATTTTTAC<br>ATATATGATCGTACACC |
| SEQ ID NO: 452 | GTATACTTTTTATTTTTGATGATGAATATTTTTATTTTTATA<br>TACATGATCGTATATAC |
| SEQ ID NO: 453 | GTATACTTTTTATTTTTGATGATAAATGTTTTTATTTTTACA<br>TATATGATCGTATATAC |
| SEQ ID NO: 454 | GGATATACTTTTTATTTTTGATGATGAATATTTTTATTTTTATA<br>TACATGATCGTATATCC |
| SEQ ID NO: 455 | GGTGATACTTTTTATTTTTGATGATGAATATTTTTATTTTTATA<br>TACATGATCGTATCACC |
| SEQ ID NO: 456 | GGTGATACTTTTTATTTTTGATGATAAATGTTTTTATTTTTAC<br>ATATATGATCGTATCACC |
| SEQ ID NO: 457 | GGTGATCCTTTTTATTTTTGATGATGAATATTTTTATTTTTATA<br>TACATGATCGGATCACC |
| SEQ ID NO: 458 | GATACTTTTTATTTTTGATATAAATATATAATTTTTATTTTTATA<br>TATATATATCGTATC |
| SEQ ID NO: 459 | GATACTTTTTATTTTTGATAAATGAATATATTTTTATTTTTATA<br>TATACATATATCGTATC |
| SEQ ID NO: 460 | GACACTTTTTATTTTTGATATAAATATATAATTTTTATTTTTAT<br>ATATATATATCGTGTC |
| SEQ ID NO: 461 | GACACTTTTTATTTTTGATAAATGAATATATTTTTATTTTTAT<br>ATACATATATCGTGTC |

TABLE 1-continued

Nucleotide sequences of blocked nucleic acid molecules.

| SEQ ID NO: | Sequence |
|---|---|
| SEQ ID NO: 462 | GACACTTTTTATTTTTGATATAAGTAAATATTTTTTATTTTTAT ATATACATATATCGTGTC |
| SEQ ID NO: 463 | GGATCTTTTTATTTTTGATATAAATATATAATTTTTATTTTTATA TATATATATATCGATCC |
| SEQ ID NO: 464 | GGATCTTTTTATTTTTGATAAATGAATATATTTTTTATTTTTATA TATACATATATCGATCC |
| SEQ ID NO: 465 | GGATCTTTTTATTTTTGATATAAGTAAATATTTTTTATTTTTATA TATACATATATCGATCC |
| SEQ ID NO: 466 | GCGTCTTTTTATTTTTGATATAAATATATAATTTTTATTTTTATA TATATATATATCGACGC |
| SEQ ID NO: 467 | GCGTCTTTTTATTTTTGATAAATGAATATATTTTTTATTTTTATA TATACATATATCGACGC |
| SEQ ID NO: 468 | GCGTCTTTTTATTTTTGATATAAGTAAATATTTTTTATTTTTATA TATACATATATCGACGC |
| SEQ ID NO: 469 | GTATATACATTTTTTATTTTTGATATAAATATATAATTTTTATTT TTATATATATATATCATGTATATAC |
| SEQ ID NO: 470 | GTATATACATTTTTTATTTTTGATAAATGAATATATTTTTTATTT TTATATATACATATATCATGTATATAC |
| SEQ ID NO: 471 | GTATATACATTTTTTATTTTTGATATAAGTAAATATTTTTTATTT TTATATATACATATATCATGTATATAC |
| SEQ ID NO: 472 | GGATATACATTTTTTATTTTTGATATAAATATATAATTTTTATT TTTATATATATATATATCATGTATATCC |
| SEQ ID NO: 473 | GGATATACACTTTTTATTTTTGATATAAATATATAATTTTTATT TTTATATATATATATATCGTGTATATCC |
| SEQ ID NO: 474 | GGATATACACTTTTTATTTTTGATAAATGAATATATTTTTTATT TTTATATATACATATATCGTGTATATCC |
| SEQ ID NO: 475 | GGATATACACTTTTTATTTTTGATATAAGTAAATATTTTTTATT TTTATATATACATATATCGTGTATATCC |
| SEQ ID NO: 476 | GGGTATATACTTTTTATTTTTGATATAAATATATAATTTTTATT TTTATATATATATATATCGTATATACCC |
| SEQ ID NO: 477 | GGGTATATACTTTTTATTTTTGATAAATGAATATATTTTTTATT TTTATATATACATATATCGTATATACCC |
| SEQ ID NO: 478 | GGGTATATACTTTTTATTTTTGATATAAGTAAATATTTTTTATT TTTATATATACATATATCGTATATACCC |
| SEQ ID NO: 479 | GTATACTTTTTATTTTTTATAAATATATATTTTTTATTTTTTAT ATATATATAGTATAC |
| SEQ ID NO: 480 | GTGATCTTTTTATTTTTTATAAATATATATTTTTTATTTTTTAT ATATATATAGATCAC |
| SEQ ID NO: 481 | GTATACTTTTTATTTTTGATATAAATATATTTTTTATTTTTTAT ATATATATCGTATAC |
| SEQ ID NO: 482 | GTATACTTTTTATTTTTGATATAAATATTTTTTATTTTTTAT ATATATATCGTATAC |
| SEQ ID NO: 483 | GTATACTTTTTATTTTTGATAAATGAATATATTTTTTATTTTTTAT ATACATATATCGTATAC |
| SEQ ID NO: 484 | GGATACTTTTTATTTTTTATAAATATATATTTTTTATTTTTTAT ATATATATAGTATCC |
| SEQ ID NO: 485 | GTGATCTTTTTATTTTTGATATAAATATATTTTTTATTTTTTAT ATATATATCGATCAC |
| SEQ ID NO: 486 | GTGATCTTTTTATTTTTGATATAAATATATTTTTTATTTTTTAT ATATATATATCGATCAC |

TABLE 1-continued

Nucleotide sequences of blocked nucleic acid molecules.

| SEQ ID NO: | Sequence |
|---|---|
| SEQ ID NO: 487 | GTGATCTTTTTATTTTTGATAAATGAATATATTTTTATTTTTTAT ATACATATATCGATCAC |
| SEQ ID NO: 488 | GGATACTTTTTATTTTTGATATAAATATATTTTTTATTTTTTAT ATATATATATCGTATCC |
| SEQ ID NO: 489 | GGATACTTTTTATTTTTGATATATAAATATTTTTTATTTTTTAT ATATATATATCGTATCC |
| SEQ ID NO: 490 | GGATACTTTTTATTTTTGATAAATGAATATATTTTTATTTTTTAT ATACATATATCGTATCC |
| SEQ ID NO: 491 | GCGATCTTTTTATTTTTTATAAATATATTTTTTATTTTTTAT ATATATATATAGATCGC |
| SEQ ID NO: 492 | GCGATCTTTTTATTTTTGATATAAATATATTTTTTATTTTTTAT ATATATATCGATCGC |
| SEQ ID NO: 493 | GCGATCTTTTTATTTTTGATATATAAATATTTTTTATTTTTTAT ATATATATCGATCGC |
| SEQ ID NO: 494 | GCGATCTTTTTATTTTTGATAAATGAATATATTTTTATTTTTTAT ATACATATATCGATCGC |
| SEQ ID NO: 495 | GATATATCACTTTTTATTTTTTATAAATATATATTTTTTATTTT TTATATATATATATAGTGATATATC |
| SEQ ID NO: 496 | GTATACATTTTTTATTTTTGATATAAATATATTTTTTATTTT TTATATATATATATCATGTATATAC |
| SEQ ID NO: 497 | GTATACATTTTTTATTTTTGATATATAAATATTTTTTATTTT TTATATATATATATCATGTATATAC |
| SEQ ID NO: 498 | GGATATACACTTTTTATTTTTTATAAATATATATTTTTTATTTT TTATATATATATATAGTGTATATCC |
| SEQ ID NO: 499 | GGATATACATTTTTTATTTTTGATATAAATATATTTTTTATTTT TTATATATATATATCATGTATATCC |
| SEQ ID NO: 500 | GGATATACATTTTTTATTTTTGATATATAAATATTTTTTATTTT TTATATATATATATCATGTATATCC |
| SEQ ID NO: 501 | GGATATACATTTTTTATTTTTGATAAATGAATATATTTTTATTT TTTATATACATATATCATGTATATCC |
| SEQ ID NO: 502 | GGGTATATACTTTTTATTTTTTATAAATATATATTTTTTATTTT TTATATATATATATAGTATATACCC |
| SEQ ID NO: 503 | GGATATACACTTTTTATTTTTGATATAAATATATTTTTTATTTT TTATATATATATATCGTGTATATCC |
| SEQ ID NO: 504 | GGATATACACTTTTTATTTTTGATATATAAATATTTTTTATTTT TTATATATATATATCGTGTATATCC |
| SEQ ID NO: 505 | GGATATACACTTTTTATTTTTGATAAATGAATATATTTTTATTT TTTATATACATATATCGTGTATATCC |
| SEQ ID NO: 506 | GGGTATACTTTTTATTTTTGATATAAATATATTTTTTATTTT TTATATATATATATCGTATATACCC |
| SEQ ID NO: 507 | GGGTATATACTTTTTATTTTTGATATATAAATATTTTTTATTTT TTATATATATATATCGTATATACCC |
| SEQ ID NO: 508 | GGGTATATACTTTTTATTTTTGATAAATGAATATATTTTTATTT TTTATATACATATATCGTATATACCC |
| SEQ ID NO: 509 | GATATACTTTTTATTTTTGATAAATATATAATTTTTATTTTTATA TATATATCGTATATC |
| SEQ ID NO: 510 | GTGATACTTTTTATTTTTGATAAATATATAATTTTTATTTTTATA TATATATCGTATCAC |
| SEQ ID NO: 511 | GGTATACTTTTTATTTTTGATAAATATATAATTTTTATTTTTATA TATATATCGTATACC |

TABLE 1-continued

Nucleotide sequences of blocked nucleic acid molecules.

| SEQ ID NO: | Sequence |
|---|---|
| SEQ ID NO: 512 | GGTGTACTTTTTATTTTTGATAAATATATAATTTTTATTTTTATATATATATATCGTACACC |
| SEQ ID NO: 513 | GTATATACATTTTTTATTTTTGATAAATATATAATTTTTATTTTTATATATATATATCATGTATATAC |
| SEQ ID NO: 514 | GGATATACATTTTTTATTTTTGATAAATATATAATTTTTATTTTTATATATATATCATGTATATCC |
| SEQ ID NO: 515 | GGATATACACTTTTTATTTTTGATAAATATATAATTTTTATTTTTATATATATATCGTGTATATCC |
| SEQ ID NO: 516 | GGGTATATACTTTTTATTTTTGATAAATATATAATTTTTATTTTTATATATATATCGTATATACCC |
| SEQ ID NO: 517 | GTATATACTTTTTATTTTTGATAAATATATTTTTTATTTTTTATATATATCGTATATAC |
| SEQ ID NO: 518 | GTATATACTTTTTATTTTTGATAAATGTATTTTTTATTTTTTATACATATATCGTATATAC |
| SEQ ID NO: 519 | GGATATACTTTTTATTTTTGATAAATATATTTTTTATTTTTTATATATATATCGTATATCC |
| SEQ ID NO: 520 | GGATATACTTTTTATTTTTGATAAATGTATTTTTTATTTTTTATACATATATCGTATATCC |
| SEQ ID NO: 521 | GGATATACTTTTTATTTTTGATGATAAATGTTTTTTATTTTTACATATATGATCGTATATCC |
| SEQ ID NO: 522 | GGTGATACTTTTTATTTTTGATAAATATATTTTTTATTTTTTATATATATATCGTATCACC |
| SEQ ID NO: 523 | GGTGATACTTTTTATTTTTGATAAATGTATTTTTTATTTTTTATACATATATCGTATCACC |
| SEQ ID NO: 524 | GGTGATCCTTTTTATTTTTGATAAATATATTTTTTATTTTTTATATATATCGGATCACC |
| SEQ ID NO: 525 | GGTGATCCTTTTTATTTTTGATAAATGTATTTTTTATTTTTTATACATATATCGGATCACC |
| SEQ ID NO: 526 | GGTGATCCTTTTTATTTTTGATGATAAATGTTTTTTATTTTTACATATATGATCGGATCACC |
| SEQ ID NO: 527 | GTATATACATTTTTTATTTTTGATAAATATATTTTTTATTTTTTATATATATATCATGTATATAC |
| SEQ ID NO: 528 | GTATATACATTTTTTATTTTTGATAAATGTATTTTTTATTTTTTATACATATATCATGTATATAC |
| SEQ ID NO: 529 | GTATATACATTTTTTATTTTTGATGATAAATGTTTTTTATTTTTACATATGATCATGTATATAC |
| SEQ ID NO: 530 | GGATATACATTTTTTATTTTTGATAAATATATTTTTTATTTTTTATATATATATCATGTATATCC |
| SEQ ID NO: 531 | GGATATACACTTTTTATTTTTGATAAATATATTTTTTATTTTTTATATATATATCGTGTATATCC |
| SEQ ID NO: 532 | GGATATACACTTTTTATTTTTGATAAATGTATTTTTTATTTTTTATACATATATCGTGTATATCC |
| SEQ ID NO: 533 | GGATATACACTTTTTATTTTTGATGATAAATGTTTTTTATTTTTACATATATGATCGTGTATATCC |
| SEQ ID NO: 534 | GGGTATATACTTTTTATTTTTGATAAATATATTTTTTATTTTTTATATATATATCGTATATACCC |
| SEQ ID NO: 535 | GGGTATATACTTTTTATTTTTGATAAATGTATTTTTTATTTTTTATACATATATCGTATATACCC |
| SEQ ID NO: 536 | GGGTATATACTTTTTATTTTTGATGATAAATGTTTTTTATTTTTACATATATGATCGTATATACCC |

TABLE 1-continued

Nucleotide sequences of blocked nucleic acid molecules.

| SEQ ID NO: | Sequence |
|---|---|
| SEQ ID NO: 537 | GTATATACATTTTTATTTTTGATAAATATTTTTTATTTTTAT ATATATCATGTATATAC |
| SEQ ID NO: 538 | GTATATACATTTTTATTTTTGATAAATGTTTTTTATTTTTAC ATATATCATGTATATAC |
| SEQ ID NO: 539 | GGATATACATTTTTATTTTTGATAAATATTTTTTATTTTTAT ATATATCATGTATATCC |
| SEQ ID NO: 540 | GGATATACATTTTTATTTTTGATAAATGTTTTTTATTTTTAC ATATATCATGTATATCC |
| SEQ ID NO: 541 | GGATATACATTTTTATTTTTGATGATGAATTTTTTATTTTTATA CATGATCATGTATATCC |
| SEQ ID NO: 542 | GGATATACACTTTTTATTTTTGATAAATATTTTTTATTTTTAT ATATATCGTGTATATCC |
| SEQ ID NO: 543 | GGATATACACTTTTTATTTTTGATAAATGTTTTTTATTTTTAC ATATATCGTGTATATCC |
| SEQ ID NO: 544 | GGGTATATACTTTTTATTTTTGATAAATATTTTTTATTTTTAT ATATATCGTATATACCC |
| SEQ ID NO: 545 | GGGTATATACTTTTTATTTTTGATAAATGTTTTTTATTTTTAC ATATATCGTATATACCC |
| SEQ ID NO: 546 | GGATGTACACTTTTTATTTTTGATAAATATTTTTTATTTTTAT ATATATCGTGTACATCC |
| SEQ ID NO: 547 | GGATGTACACTTTTTATTTTTGATAAATGTTTTTTATTTTTAC ATATATCGTGTACATCC |
| SEQ ID NO: 548 | GTACATATATTTTTTATTTTTGATAAATATTTTTTATTTTTTA TATATATCAATATATGTAC |
| SEQ ID NO: 549 | GTACATATATTTTTTATTTTTGATAAATGTTTTTTATTTTTTA CATATATCAATATATGTAC |
| SEQ ID NO: 550 | GGTACATATATTTTTTATTTTTGATAAATATTTTTTATTTTTTA TATATATCATATATGTACC |
| SEQ ID NO: 551 | GGTACATATATTTTTTATTTTTGATAAATGTTTTTTATTTTTTA CATATATCATATATGTACC |
| SEQ ID NO: 552 | CGATCATATATTTTTTATTTTTGATAAATATTTTTTATTTTTT ATATATATCAATATATGATCG |
| SEQ ID NO: 553 | CGATCATATATTTTTTATTTTTGATAAATGTTTTTTATTTTTT ACATATATCAATATATGATCG |
| SEQ ID NO: 554 | CGATCATATATTTTTTATTTTTGATGATGAATTTTTTATTTTTA TACATGATCAATATATGATCG |
| SEQ ID NO: 555 | CGATCATATATTTTTTATTTTTGATGATAAATTTTTTATTTTTA TATATGATCAATATATGATCG |
| SEQ ID NO: 556 | GTATATACTTTTTATTTTTGATATAAATATATAATTTTTATTTTT ATATATATATATCGTATATAC |
| SEQ ID NO: 557 | GTATATACTTTTTATTTTTGATAAATGAATATATTTTTATTTTT ATATATACATATATCGTATATAC |
| SEQ ID NO: 558 | GGATATACTTTTTATTTTTGATATAAATATATAATTTTTATTTTT ATATATATATATCGTATATCC |
| SEQ ID NO: 559 | GGATATACTTTTTATTTTTGATAAATGAATATATTTTTATTTTT ATATATACATATATCGTATATCC |
| SEQ ID NO: 560 | GGTGATACTTTTTATTTTTGATATAAATATATAATTTTTATTTTT ATATATATATATCGTATCACC |
| SEQ ID NO: 561 | GGTGATACTTTTTATTTTTGATAAATGAATATATTTTTATTTTT ATATATACATATATCGTATCACC |

TABLE 1-continued

Nucleotide sequences of blocked nucleic acid molecules.

| SEQ ID NO: | Sequence |
| --- | --- |
| SEQ ID NO: 562 | GGTGATCCTTTTTATTTTTGATATAAATATATAATTTTTATTTTT ATATATATATATATCGGATCACC |
| SEQ ID NO: 563 | GGTGATCCTTTTTATTTTTGATAAATGAATATATTTTTATTTTT ATATACATATATCGGATCACC |
| SEQ ID NO: 564 | GTATATACTTTTTATTTTTGATATAAGTAAATATTTTTATTTTT ATATACATATATCGTATATAC |
| SEQ ID NO: 565 | GGATATACTTTTTATTTTTGATATAAGTAAATATTTTTATTTTT ATATACATATATCGTATATCC |
| SEQ ID NO: 566 | GGTGATACTTTTTATTTTTGATATAAGTAAATATTTTTATTTTT ATATACATATATCGTATCACC |
| SEQ ID NO: 567 | GGTGATCCTTTTTATTTTTGATATAAGTAAATATTTTTATTTTT ATATACATATATCGGATCACC |
| SEQ ID NO: 568 | GTATATACTTTTTATTTTTTATAAATATATATTTTTTATTTTTT ATATATATATAGTATATAC |
| SEQ ID NO: 569 | GTATATACTTTTTATTTTTGATATAAATATATTTTTTATTTTTT ATATATATATCGTATATAC |
| SEQ ID NO: 570 | GTATATACTTTTTATTTTTGATAAATGAATATATTTTTATTTTT ATATACATATATCGTATATAC |
| SEQ ID NO: 571 | GGATATACTTTTTATTTTTTATAAATATATATTTTTTATTTTTT ATATATATATAGTATATCC |
| SEQ ID NO: 572 | GGATATACTTTTTATTTTTGATATAAATATATTTTTTATTTTTT ATATATATATCGTATATCC |
| SEQ ID NO: 573 | GGATATACTTTTTATTTTTGATAAATGAATATATTTTTATTTTT ATATACATATATCGTATATCC |
| SEQ ID NO: 574 | GGTGATACTTTTTATTTTTTATAAATATATATTTTTTATTTTTT ATATATATATAGTATCACC |
| SEQ ID NO: 575 | GGTGATACTTTTTATTTTTGATATAAATATATTTTTTATTTTTT ATATATATATCGTATCACC |
| SEQ ID NO: 576 | GGTGATACTTTTTATTTTTGATAAATGAATATATTTTTATTTTT ATATACATATATCGTATCACC |
| SEQ ID NO: 577 | GGTGATCCTTTTTATTTTTTATAAATATATATTTTTTATTTTTT ATATATATATAGGATCACC |
| SEQ ID NO: 578 | GGTGATCCTTTTTATTTTTGATATAAATATATTTTTTATTTTTT ATATATATATCGGATCACC |
| SEQ ID NO: 579 | GGTGATCCTTTTTATTTTTGATAAATGAATATATTTTTATTTTT ATATACATATATCGGATCACC |
| SEQ ID NO: 580 | GTATATACTTTTTATTTTTGATATAAATATATTTTTTATTTTTT ATATATATATCGTATATAC |
| SEQ ID NO: 581 | GGATATACTTTTTATTTTTGATATAAATATTTTTTTATTTTTT ATATATATATCGTATATCC |
| SEQ ID NO: 582 | GGTGATACTTTTTATTTTTGATATAAATATTTTTTTATTTTTT ATATATATATCGTATCACC |
| SEQ ID NO: 583 | GGTGATCCTTTTTATTTTTGATATAAATATTTTTTTATTTTTT ATATATATATCGGATCACC |
| SEQ ID NO: 584 | GATACAAAAAAAAAAATATATATATATATAAAAAAAAAA ATATATATATATAGTATC |
| SEQ ID NO: 585 | GACACAAAAAAAAAAAGATATATATATATATAAAAAAAAAA ATATATATATATCGTGTC |
| SEQ ID NO: 586 | GATATACAAAAAAAAAAAATATATATATATATAAAAAAAAAA ATATATATATATAGTATATC |

TABLE 1-continued

Nucleotide sequences of blocked nucleic acid molecules.

| SEQ ID NO: | Sequence |
|---|---|
| SEQ ID NO: 587 | GATATATAAAAAAAAAAAGATATATGTATATAAAAAAAAAA ATATACATATATCATATATC |
| SEQ ID NO: 588 | GATATACAAAAAAAAAAAGATATATATATATAAAAAAAAAA ATATATATATATCGTATATC |
| SEQ ID NO: 589 | GGTATACAAAAAAAAAAATATATATATATATAAAAAAAAAA ATATATATATAGTATACC |
| SEQ ID NO: 590 | GATATATCACAAAAAAAAAAATATATATATAAAAAAAAAAA TATATATAGTGATATATC |
| SEQ ID NO: 591 | GTATATACATAAAAAAAAAAAGATATATGTAAAAAAAAAAA TACATATATCATGTATATAC |
| SEQ ID NO: 592 | GGATATACATAAAAAAAAAAAGATATATGTAAAAAAAAAA ATACATATATCATGTATATCC |
| SEQ ID NO: 593 | GGATATACATAAAAAAAAAAAGATCATGTATAAAAAAAAAA ATACATGATCATGTATATCC |
| SEQ ID NO: 594 | GGGTATATACAAAAAAAAAAATATATATATAAAAAAAAAAA TATATATAGTATATACCC |
| SEQ ID NO: 595 | GTATATACAAAAAAAAAAATATATATATATATATAAAAAAAA AAAATATATATATATAGTATATAC |
| SEQ ID NO: 596 | GTATATACAAAAAAAAAAAGATATATATATATATAAAAAAAA AAAATATATATATATCGTATATAC |
| SEQ ID NO: 597 | GGATATACAAAAAAAAAAATATATATATATATATAAAAAAAA AAAATATATATATATAGTATATCC |
| SEQ ID NO: 598 | GGATATACAAAAAAAAAAAGATATATATATATATAAAAAAAA AAAATATATATATATCGTATATCC |
| SEQ ID NO: 599 | GTATATACAAAAAAAAAAATATATATATATATAAAAAAAAAA AATATATATATATAGTATATAC |
| SEQ ID NO: 600 | GTATATACAAAAAAAAAAAGATATATATATATAAAAAAAAAA AATATATATATATCGTATATAC |
| SEQ ID NO: 601 | GGATATACAAAAAAAAAAATATATATATATATAAAAAAAAAA AATATATATATATAGTATATCC |
| SEQ ID NO: 602 | GGATATACAAAAAAAAAAAGATATATATATATAAAAAAAAAA AATATATATATATCGTATATCC |
| SEQ ID NO: 603 | GATATATCACAAAAAAAAAAATATATATATATAAAAAAAAAA AATATATATATAGTGATATATC |
| SEQ ID NO: 604 | GGATATACATAAAAAAAAAAAGATATATATATAAAAAAAAAA AATATATATATATCATGTATATCC |
| SEQ ID NO: 605 | GTACATATATTAAAAAAAAAAAGATATATATAAAAAAAAAAA ATATATATATCAATATATGTAC |
| SEQ ID NO: 606 | GATGTATATACAAAAAAAAAAAATATATATATAAAAAAAAAA ATATATATAGTATATACATC |
| SEQ ID NO: 607 | CGATCATATATTAAAAAAAAAAAGATATATATAAAAAAAAAA AATATATATATCAATATATGATCG |
| SEQ ID NO: 608 | CGATCATATATTAAAAAAAAAAAGATATATGTAAAAAAAAAA AATACATATATCAATATATGATCG |
| SEQ ID NO: 609 | GATACAAAAAAAAAAATATAAATATATATATAAAAAAAAAAA ATATATATATATAGTATC |
| SEQ ID NO: 610 | GGATCAAAAAAAAAAATATAAATATATATATAAAAAAAAAAA ATATATATATATAGATCC |
| SEQ ID NO: 611 | GACACAAAAAAAAAAAGATAAATATATATATAAAAAAAAAA AATATATATATATCGTGTC |

TABLE 1-continued

Nucleotide sequences of blocked nucleic acid molecules.

| SEQ ID NO: | Sequence |
|---|---|
| SEQ ID NO: 612 | GACACAAAAAAAAAAAGATGATGTATATATAAAAAAAAAA ATATATATACATGATCGTGTC |
| SEQ ID NO: 613 | GCGTCAAAAAAAAAAAGATAAATATATATAAAAAAAAAA ATATATATATATATCGACGC |
| SEQ ID NO: 614 | GATATACAAAAAAAAAAAATATAAATATATAAAAAAAAAA ATATATATATAGTATATC |
| SEQ ID NO: 615 | GTATATACATAAAAAAAAAAAGATAAATGTAAAAAAAAAA ATACATATATCATGTATATAC |
| SEQ ID NO: 616 | GTATATACATAAAAAAAAAAAGATGATATATAAAAAAAAAA ATATATGATCATGTATATAC |
| SEQ ID NO: 617 | GGATATACATAAAAAAAAAAAGATAAATATAAAAAAAAAA ATATATATATCATGTATATCC |
| SEQ ID NO: 618 | GGATATACATAAAAAAAAAAAGATGATATATAAAAAAAAAA AATATATGATCATGTATATCC |
| SEQ ID NO: 619 | GTATATACAAAAAAAAAAATATAAATATATATAAAAAAAA AAAATATATATATATAGTATATAC |
| SEQ ID NO: 620 | GTATATACAAAAAAAAAAAGATAAATATATATAAAAAAAA AAAATATATATATATCGTATATAC |
| SEQ ID NO: 621 | GGATATACAAAAAAAAAAATATAAATATATATAAAAAAAA AAAATATATATATATAGTATATCC |
| SEQ ID NO: 622 | GGATATACAAAAAAAAAAAGATAAATATATATAAAAAAAA AAAATATATATATATCGTATATCC |
| SEQ ID NO: 623 | GTATATACAAAAAAAAAAAGATAAATGTATATAAAAAAAA AATATATACATATATCGTATATAC |
| SEQ ID NO: 624 | GGATATACAAAAAAAAAAAGATAAATGTATATAAAAAAAA AAATATATACATATATCGTATATCC |
| SEQ ID NO: 625 | GGTGATACAAAAAAAAAAAGATGATGTATATATAAAAAAAA AAATATATACATGATCGTATCACC |
| SEQ ID NO: 626 | GATATATCACAAAAAAAAAAATATAAATATATATAAAAAAA AAAATATATATATATAGTGATATATC |
| SEQ ID NO: 627 | GTATATACATAAAAAAAAAAAGATAAATATATAAAAAAAAAA AATATATATATATCATGTATATAC |
| SEQ ID NO: 628 | GTATATACATAAAAAAAAAAAGATGATATATGTAAAAAAAA AAACATATATGATCATGTATATAC |
| SEQ ID NO: 629 | GGATATACATAAAAAAAAAAAGATAAATATATAAAAAAAAAA AAATATATATATCATGTATATCC |
| SEQ ID NO: 630 | GTACATATATTAAAAAAAAAAGATAAATATAAAAAAAAAA ATATATATATCAATATATGTAC |
| SEQ ID NO: 631 | GTACATATATTAAAAAAAAAAGATAAATGTAAAAAAAAAA ATACATATATCAATATATGTAC |
| SEQ ID NO: 632 | GTACATATATTAAAAAAAAAAGATGATATATAAAAAAAAAA AATATATGATCAATATATGTAC |
| SEQ ID NO: 633 | GGATATACATAAAAAAAAAAAGATGATGAATAAAAAAAAAA AATACATGATCATGTATATCC |
| SEQ ID NO: 634 | GTATATACATAAAAAAAAAAAGATAAATGTTAAAAAAAAAA TACATATATCATGTATATAC |
| SEQ ID NO: 635 | GATACAAAAAAAAAAAGATATAAATATATAAAAAAAAAA AATATATATATATCGTATC |
| SEQ ID NO: 636 | GATACAAAAAAAAAAAGATGATATAAGTACTAAAAAAAAAA AAGTACATATATGATCGTATC |

TABLE 1-continued

Nucleotide sequences of blocked nucleic acid molecules.

| SEQ ID NO: | Sequence |
|---|---|
| SEQ ID NO: 637 | GACACAAAAAAAAAAAGATAAATGAATATATAAAAAAAAAA AATATATACATATATCGTGTC |
| SEQ ID NO: 638 | GGATATACAAAAAAAAAAAGATATAAGTAAATATAAAAAAA AAAAATATATACATATATCGTATATCC |
| SEQ ID NO: 639 | GGATATACAAAAAAAAAAAGATGATATAAGTACTAAAAAAA AAAAGTACATATATGATCGTATATCC |
| SEQ ID NO: 640 | GTATATACAAAAAAAAAAAGATATAAGTAAATATAAAAAAA AAAATATATACATATATCGTATATAC |
| SEQ ID NO: 641 | GTATATACAAAAAAAAAAAGATGATATAAGTACTAAAAAAA AAAAGTACATATATGATCGTATATAC |
| SEQ ID NO: 642 | GGATATACAAAAAAAAAAAGATAAATGAATATAAAAAAAAA AAATATATACATATATCGTATATCC |
| SEQ ID NO: 643 | GTATATACAAAAAAAAAAAGATAAATGAATATAAAAAAAAA AAATATATACATATATCGTATATAC |
| SEQ ID NO: 644 | GTATATACAAAAAAAAAAAGATGATATAAGTACAAAAAAAA AAGTACATATATGATCGTATATAC |
| SEQ ID NO: 645 | GTATATACAAAAAAAAAAATATAAATATATATTAAAAAAAA AATATATATATATAGTATATAC |
| SEQ ID NO: 646 | GTATATACATAAAAAAAAAAGATGATGTAAATATAAAAAAA AAAAATATATACATGATCATGTATATAC |
| SEQ ID NO: 647 | GATATACAAAAAAAAAAAGATAAATATATAAAAAAAAAAA AATATATATATATCGTATATC |
| SEQ ID NO: 648 | GTGATACAAAAAAAAAAAGATAAATATATAAAAAAAAAAA AATATATATATATCGTATCAC |
| SEQ ID NO: 649 | GGTATACAAAAAAAAAAAGATAAATATATAAAAAAAAAAA AATATATATATATCGTATACC |
| SEQ ID NO: 650 | GGATATACATAAAAAAAAAAGATAAATGAATAAAAAAAAAA AAATATACATATATCATGTATATCC |
| SEQ ID NO: 651 | GTATATACATAAAAAAAAAAGATAAATGTATTAAAAAAAAA AATATACATATATCATGTATATAC |
| SEQ ID NO: 652 | GTATATACATAAAAAAAAAAAGATGATAAATGTAAAAAAAA AAACATATATGATCATGTATATAC |
| SEQ ID NO: 653 | GATACTTTTTATTTTTTATATATATATATATTTTTATTTTTATA T*A*T*A*T*A*T*A*T*A*T*A*G*T*A*T*C |
| SEQ ID NO: 654 | GACACTTTTTATTTTTTATATATATATATATTTTTTATTTTTATA T*A*T*A*T*A*T*A*T*A*T*A*G*T*G*T*C |
| SEQ ID NO: 655 | GATACTTTTTATTTTTGATATATATATATATTTTTTATTTTTATA T*A*T*A*T*A*T*A*T*A*T*C*G*T*A*T*C |
| SEQ ID NO: 656 | GGATCTTTTTATTTTTTATATATATATATATTTTTTATTTTTATA T*A*T*A*T*A*T*A*T*A*T*A*G*A*T*C*C |
| SEQ ID NO: 657 | GACACTTTTTATTTTTGATATATATATATATTTTTTATTTTTATA T*A*T*A*T*A*T*A*T*A*T*C*G*T*G*T*C |
| SEQ ID NO: 658 | GGATCTTTTTATTTTTGATATATATATATATTTTTTATTTTTATA T*A*T*A*T*A*T*A*T*A*T*C*G*A*T*C*C |
| SEQ ID NO: 659 | GCGTCTTTTTATTTTTTATATATATATATATTTTTTATTTTTATA T*A*T*A*T*A*T*A*T*A*T*A*G*A*C*G*C |
| SEQ ID NO: 660 | GCGTCTTTTTATTTTTGATATATATATATATTTTTTATTTTTATA T*A*T*A*T*A*T*A*T*A*T*C*G*A*C*G*C |
| SEQ ID NO: 661 | GTATACTTTTTATTTTTTATATATATATATATTTTTATTTTTTAT A*T*A*T*A*T*A*T*A*T*A*G*T*A*T*A*C |

TABLE 1-continued

Nucleotide sequences of blocked nucleic acid molecules.

| SEQ ID NO: | Sequence |
| --- | --- |
| SEQ ID NO: 662 | GTGATCTTTTTATTTTTTATATATATATATATTTTTATTTTTAT<br>A*T*A*T*A*T*A*T*A*G*A*T*C*A*C |
| SEQ ID NO: 663 | GTATACTTTTTATTTTTGATATATATATATATTTTTATTTTTAT<br>A*T*A*T*A*T*A*T*A*T*C*G*T*A*T*A*C |
| SEQ ID NO: 664 | GTATACTTTTTATTTTTGATATATGTATATATTTTTATTTTTAT<br>A*T*A*C*A*T*A*T*A*T*C*G*T*A*T*A*C |
| SEQ ID NO: 665 | GGATACTTTTTATTTTTTATATATATATATATTTTTATTTTTAT<br>A*T*A*T*A*T*A*T*A*T*A*G*T*A*T*C*C |
| SEQ ID NO: 666 | GTGATCTTTTTATTTTTGATATATATATATATTTTTATTTTTAT<br>A*T*A*T*A*T*A*T*A*T*C*G*A*T*C*A*C |
| SEQ ID NO: 667 | GTGATCTTTTTATTTTTGATATGTATATATTTTTATTTTTAT<br>A*T*A*C*A*T*A*T*A*T*C*G*A*T*C*A*C |
| SEQ ID NO: 668 | GGATACTTTTTATTTTTGATATATATATATATTTTTATTTTTAT<br>A*T*A*T*A*T*A*T*A*T*C*G*T*A*T*C*C |
| SEQ ID NO: 669 | GGATACTTTTTATTTTTGATATGTATATATTTTTATTTTTAT<br>A*T*A*C*A*T*A*T*A*T*C*G*T*A*T*C*C |
| SEQ ID NO: 670 | GCGATCTTTTTATTTTTTATATATATATATATTTTTATTTTTAT<br>A*T*A*T*A*T*A*T*A*T*A*G*A*T*C*G*C |
| SEQ ID NO: 671 | GCGATCTTTTTATTTTTGATATATATATATATTTTTATTTTTAT<br>A*T*A*T*A*T*A*T*A*T*C*G*A*T*C*G*C |
| SEQ ID NO: 672 | GCGATCTTTTTATTTTTGATATGTATATATTTTTATTTTTAT<br>A*T*A*C*A*T*A*T*A*T*C*G*A*T*C*G*C |
| SEQ ID NO: 673 | GATATACTTTTTATTTTTTATATATATATATTTTTATTTTTATA<br>T*A*T*A*T*A*T*A*G*T*A*T*A*T*C |
| SEQ ID NO: 674 | GATATATTTTTATTTTTGATATATATATATATTTTTATTTTTATA<br>T*A*T*A*T*A*T*A*T*C*A*T*A*T*A*T*C |
| SEQ ID NO: 675 | GATATATTTTTATTTTTGATATGTATATTTTTATTTTTATA<br>T*A*C*A*T*A*T*A*T*C*A*T*A*T*A*T*C |
| SEQ ID NO: 676 | GTGATACTTTTTATTTTTTATATATATATATATTTTTATTTTTATA<br>T*A*T*A*T*A*T*A*T*A*G*T*A*T*C*A*C |
| SEQ ID NO: 677 | GATATACTTTTTATTTTTGATATATATATATATTTTTATTTTTATA<br>T*A*T*A*T*A*T*A*T*C*G*T*A*T*A*T*C |
| SEQ ID NO: 678 | GATATACTTTTTATTTTTGATATGTATATTTTTATTTTTATA<br>T*A*C*A*T*A*T*A*T*C*G*T*A*T*A*T*C |
| SEQ ID NO: 679 | GGTATACTTTTTATTTTTTATATATATATATATTTTTATTTTTATA<br>T*A*T*A*T*A*T*A*T*A*G*T*A*T*A*C*C |
| SEQ ID NO: 680 | GTGATACTTTTTATTTTTGATATATATATATATTTTTATTTTTATA<br>T*A*T*A*T*A*T*A*T*C*G*T*A*T*C*A*C |
| SEQ ID NO: 681 | GTGATACTTTTTATTTTTGATATGTATATTTTTATTTTTATA<br>T*A*C*A*T*A*T*A*T*C*G*T*A*T*C*A*C |
| SEQ ID NO: 682 | GGTATACTTTTTATTTTTGATATATATATATATTTTTATTTTTATA<br>T*A*T*A*T*A*T*A*T*C*G*T*A*T*A*C*C |
| SEQ ID NO: 683 | GGTATACTTTTTATTTTTGATATGTATATTTTTATTTTTATA<br>T*A*C*A*T*A*T*A*T*C*G*T*A*T*A*C*C |
| SEQ ID NO: 684 | GGTGTACTTTTTATTTTTTATATATATATATATTTTTATTTTTATA<br>T*A*T*A*T*A*T*A*T*A*G*T*A*C*A*C*C |
| SEQ ID NO: 685 | GGTGTACTTTTTATTTTTGATATATATATATATTTTTATTTTTATA<br>T*A*T*A*T*A*T*A*T*C*G*T*A*C*A*C*C |
| SEQ ID NO: 686 | GGTGTACTTTTTATTTTTGATATGTATATTTTTATTTTTATA<br>T*A*C*A*T*A*T*A*T*C*G*T*A*C*A*C*C |

TABLE 1-continued

Nucleotide sequences of blocked nucleic acid molecules.

| SEQ ID NO: | Sequence |
|---|---|
| SEQ ID NO: 687 | GTATATACTTTTTATTTTTATATATATATATTTTTATTTTTAT<br>A*T*A*T*A*T*A*T*A*G*T*A*T*A*T*A*C |
| SEQ ID NO: 688 | GTATATACTTTTTATTTTTGATATATATATATTTTTATTTTTAT<br>A*T*A*T*A*T*A*T*C*G*T*A*T*A*T*A*C |
| SEQ ID NO: 689 | GTATATACTTTTTATTTTTGATATATGTATATTTTTATTTTTAT<br>A*C*A*T*A*T*A*T*C*G*T*A*T*A*T*A*C |
| SEQ ID NO: 690 | GTATATACTTTTTATTTTTGATCATGTATATTTTTATTTTTATA<br>T*A*C*A*T*G*A*T*C*G*T*A*T*A*T*A*C |
| SEQ ID NO: 691 | GTATATACTTTTTATTTTTGATCATATATGTTTTTTATTTTTACA<br>T*A*T*A*T*G*A*T*C*G*T*A*T*A*T*A*C |
| SEQ ID NO: 692 | GGATATACTTTTTATTTTTTATATATATATATTTTTATTTTTAT<br>A*T*A*T*A*T*A*T*A*G*T*A*T*A*T*C*C |
| SEQ ID NO: 693 | GGATATACTTTTTATTTTTGATATATATATATTTTTATTTTTAT<br>A*T*A*T*A*T*A*T*C*G*T*A*T*A*T*C*C |
| SEQ ID NO: 694 | GGATATACTTTTTATTTTTGATATATGTATATTTTTATTTTTAT<br>A*C*A*T*A*T*A*T*C*G*T*A*T*A*T*C*C |
| SEQ ID NO: 695 | GGATATACTTTTTATTTTTGATCATGTATATTTTTATTTTTATA<br>T*A*C*A*T*G*A*T*C*G*T*A*T*A*T*C*C |
| SEQ ID NO: 696 | GGATATACTTTTTATTTTTGATCATATATGTTTTTTATTTTTACA<br>T*A*T*A*T*G*A*T*C*G*T*A*T*A*T*C*C |
| SEQ ID NO: 697 | GGTGATACTTTTTATTTTTTATATATATATATTTTTATTTTTAT<br>A*T*A*T*A*T*A*T*A*G*T*A*T*C*A*C*C |
| SEQ ID NO: 698 | GGTGATACTTTTTATTTTTGATATATATATATTTTTATTTTTAT<br>A*T*A*T*A*T*A*T*C*G*T*A*T*C*A*C*C |
| SEQ ID NO: 699 | GGTGATACTTTTTATTTTTGATATATGTATATTTTTATTTTTAT<br>A*C*A*T*A*T*A*T*C*G*T*A*T*C*A*C*C |
| SEQ ID NO: 700 | GGTGATACTTTTTATTTTTGATCATGTATATTTTTATTTTTATA<br>T*A*C*A*T*G*A*T*C*G*T*A*T*C*A*C*C |
| SEQ ID NO: 701 | GGTGATACTTTTTATTTTTGATCATATATGTTTTTTATTTTTACA<br>T*A*T*A*T*G*A*T*C*G*T*A*T*C*A*C*C |
| SEQ ID NO: 702 | GGTGATCCTTTTTATTTTTTATATATATATATTTTTATTTTTAT<br>A*T*A*T*A*T*A*T*A*G*G*A*T*C*A*C*C |
| SEQ ID NO: 703 | GGTGATCCTTTTTATTTTTGATATATATATATTTTTATTTTTAT<br>A*T*A*T*A*T*A*T*C*G*G*A*T*C*A*C*C |
| SEQ ID NO: 704 | GGTGATCCTTTTTATTTTTGATATATGTATATTTTTATTTTTAT<br>A*C*A*T*A*T*A*T*C*G*G*A*T*C*A*C*C |
| SEQ ID NO: 705 | GGTGATCCTTTTTATTTTTGATCATGTATATTTTTATTTTTATA<br>T*A*C*A*T*G*A*T*C*G*G*A*T*C*A*C*C |
| SEQ ID NO: 706 | GGTGATCCTTTTTATTTTTGATCATATATGTTTTTTATTTTTACA<br>T*A*T*A*T*G*A*T*C*G*G*A*T*C*A*C*C |
| SEQ ID NO: 707 | GATATATCACTTTTTATTTTTTATATATATATTTTTATTTTTAT<br>A*T*A*T*A*T*A*G*T*G*A*T*A*T*A*T*C |
| SEQ ID NO: 708 | GTATATACATTTTTTATTTTTGATATATATATTTTTATTTTTAT<br>A*T*A*T*A*T*C*A*T*G*T*A*T*A*T*A*C |
| SEQ ID NO: 709 | GTATATACATTTTTTATTTTTGATATATGTATTTTTATTTTTAC<br>A*T*A*T*A*T*C*A*T*G*T*A*T*A*T*A*C |
| SEQ ID NO: 710 | GTATATACATTTTTTATTTTTGATCATGTATTTTTATTTTTATA<br>C*A*T*G*A*T*C*A*T*G*T*A*T*A*T*A*C |
| SEQ ID NO: 711 | GTATATACATTTTTTATTTTTGATCATATATTTTTATTTTTATA<br>T*A*T*G*A*T*C*A*T*G*T*A*T*A*T*A*C |

TABLE 1-continued

Nucleotide sequences of blocked nucleic acid molecules.

| SEQ ID NO: | Sequence |
| --- | --- |
| SEQ ID NO: 712 | GGATATACACTTTTTATTTTTTATATATATATTTTTATTTTTAT<br>A*T*A*T*A*T*A*G*T*G*T*A*T*A*T*C*C |
| SEQ ID NO: 713 | GGATATACATTTTTTATTTTTGATATATATATTTTTATTTTTAT<br>A*T*A*T*A*T*C*A*T*G*T*A*T*A*T*C*C |
| SEQ ID NO: 714 | GGATATACATTTTTTATTTTTGATATATGTATTTTTATTTTTAC<br>A*T*A*T*A*T*C*A*T*G*T*A*T*A*T*C*C |
| SEQ ID NO: 715 | GGATATACATTTTTTATTTTTGATCATGTATTTTTATTTTTATA<br>C*A*T*G*A*T*C*A*T*G*T*A*T*A*T*C*C |
| SEQ ID NO: 716 | GGATATACATTTTTTATTTTTGATCATATATTTTTATTTTTATA<br>T*A*T*G*A*T*C*A*T*G*T*A*T*A*T*C*C |
| SEQ ID NO: 717 | GGGTATATACTTTTTATTTTTTATATATATATTTTTATTTTTTAT<br>A*T*A*T*A*T*A*G*T*A*T*A*T*A*C*C*C |
| SEQ ID NO: 718 | GGATATACACTTTTTATTTTTGATATATATATTTTTATTTTTAT<br>A*T*A*T*A*T*C*G*T*G*T*A*T*A*T*C*C |
| SEQ ID NO: 719 | GGATATACACTTTTTATTTTTGATATATGTATTTTTATTTTTAC<br>A*T*A*T*A*T*C*G*T*G*T*A*T*A*T*C*C |
| SEQ ID NO: 720 | GGATATACACTTTTTATTTTTGATCATGTATTTTTATTTTTATA<br>C*A*T*G*A*T*C*G*T*G*T*A*T*A*T*C*C |
| SEQ ID NO: 721 | GGATATACACTTTTTATTTTTGATCATATATTTTTATTTTTATA<br>T*A*T*G*A*T*C*G*T*G*T*A*T*A*T*C*C |
| SEQ ID NO: 722 | GGGTATATACTTTTTATTTTTGATATATATATTTTTATTTTTAT<br>A*T*A*T*A*T*C*G*T*A*T*A*T*A*C*C*C |
| SEQ ID NO: 723 | GGGTATATACTTTTTATTTTTGATATATGTATTTTTATTTTTAC<br>A*T*A*T*A*T*C*G*T*A*T*A*T*A*C*C*C |
| SEQ ID NO: 724 | GGGTATATACTTTTTATTTTTGATCATGTATTTTTATTTTTATA<br>C*A*T*G*A*T*C*G*T*A*T*A*T*A*C*C*C |
| SEQ ID NO: 725 | GGGTATATACTTTTTATTTTTGATCATATATTTTTATTTTTATA<br>T*A*T*G*A*T*C*G*T*A*T*A*T*A*C*C*C |
| SEQ ID NO: 726 | GGATGTACACTTTTTATTTTTTATATATATATTTTTATTTTTAT<br>A*T*A*T*A*T*A*G*T*G*T*A*C*A*T*C*C |
| SEQ ID NO: 727 | GGATGTACACTTTTTATTTTTGATATATATATTTTTATTTTTAT<br>A*T*A*T*A*T*C*G*T*G*T*A*C*A*T*C*C |
| SEQ ID NO: 728 | GGATGTACACTTTTTATTTTTGATATATGTATTTTTATTTTTAC<br>A*T*A*T*A*T*C*G*T*G*T*A*C*A*T*C*C |
| SEQ ID NO: 729 | GGATGTACACTTTTTATTTTTGATCATGTATTTTTATTTTTATA<br>C*A*T*G*A*T*C*G*T*G*T*A*C*A*T*C*C |
| SEQ ID NO: 730 | GGATGTACACTTTTTATTTTTGATCATATATTTTTATTTTTATA<br>T*A*T*G*A*T*C*G*T*G*T*A*C*A*T*C*C |
| SEQ ID NO: 731 | GTATATACTTTTTATTTTTTATATATATATATTTTTTATTTTT<br>ATAT*A*T*A*T*A*T*A*T*A*T*A*G*T*A*T*ATAC |
| SEQ ID NO: 732 | GTATATACTTTTTATTTTTGATATATATATATTTTTTATTTTT<br>ATAT*A*T*A*T*A*T*A*T*A*T*C*G*T*A*T*ATAC |
| SEQ ID NO: 733 | GGATATACTTTTTATTTTTTATATATATATATTTTTTATTTTT<br>ATAT*A*T*A*T*A*T*A*T*A*T*A*G*T*A*T*ATCC |
| SEQ ID NO: 734 | GGATATACTTTTTATTTTTGATATATATATATTTTTTATTTTT<br>ATAT*A*T*A*T*A*T*A*T*A*T*C*G*T*A*T*ATCC |
| SEQ ID NO: 735 | GGTGATACTTTTTATTTTTTATATATATATATTTTTTATTTTT<br>ATAT*A*T*A*T*A*T*A*T*A*T*A*G*T*A*T*CACC |
| SEQ ID NO: 736 | GGTGATACTTTTTATTTTTGATATATATATATTTTTTATTTTT<br>ATAT*A*T*A*T*A*T*A*T*A*T*C*G*T*A*T*CACC |

TABLE 1-continued

Nucleotide sequences of blocked nucleic acid molecules.

| SEQ ID NO: | Sequence |
| --- | --- |
| SEQ ID NO: 737 | GGTGATCCTTTTTATTTTTATATATATATATATTTTTATTTTT<br>ATAT*A*T*A*T*A*T*A*T*A*G*G*A*T*CACC |
| SEQ ID NO: 738 | GGTGATCCTTTTTATTTTTGATATATATATATATTTTTATTTTT<br>ATAT*A*T*A*T*A*T*A*T*A*T*C*G*G*A*T*CACC |
| SEQ ID NO: 739 | GATATATCACTTTTTATTTTTTATATATATATATATTTTTTATTT<br>TTATAT*A*T*A*T*A*T*A*T*A*T*A*G*T*G*A*TATATC |
| SEQ ID NO: 740 | GTATATACATTTTTTATTTTTGATATATATATATATTTTTTATTT<br>TTATAT*A*T*A*T*A*T*A*T*A*T*C*A*T*G*T*ATATAC |
| SEQ ID NO: 741 | GGATATACACTTTTTATTTTTTATATATATATATATTTTTTATTT<br>TTATAT*A*T*A*T*A*T*A*T*A*T*A*G*T*G*T*ATATCC |
| SEQ ID NO: 742 | GGATATACATTTTTTATTTTTGATATATATATATATTTTTTATTT<br>TTATAT*A*T*A*T*A*T*A*T*A*T*C*A*T*G*T*ATATCC |
| SEQ ID NO: 743 | GGGTATATACTTTTTATTTTTTATATATATATATATATTTTTTATTT<br>TTATAT*A*T*A*T*A*T*A*T*A*T*A*G*T*A*T*ATACCC |
| SEQ ID NO: 744 | GGATATACACTTTTTATTTTTGATATATATATATATTTTTTATTT<br>TTATAT*A*T*A*T*A*T*A*T*A*T*C*G*T*G*T*ATATCC |
| SEQ ID NO: 745 | GGGTATATACTTTTTATTTTTGATATATATATATATATTTTTTATTT<br>TTATAT*A*T*A*T*A*T*A*T*A*T*C*G*T*A*T*ATACCC |
| SEQ ID NO: 746 | GTATATACTTTTTATTTTTTATATATATATATATTTTTATTTTT<br>ATA*T*A*T*A*T*A*T*A*T*A*G*T*A*T*A*TAC |
| SEQ ID NO: 747 | GTATATACTTTTTATTTTTGATATATATATATATTTTTATTTTT<br>ATA*T*A*T*A*T*A*T*A*T*C*G*T*A*T*A*TAC |
| SEQ ID NO: 748 | GTATATACTTTTTATTTTTGATATATGTATATATTTTTATTTTT<br>ATA*T*A*C*A*T*A*T*A*T*C*G*T*A*T*A*TAC |
| SEQ ID NO: 749 | GGATATACTTTTTATTTTTTATATATATATATATTTTTATTTTT<br>ATA*T*A*T*A*T*A*T*A*T*A*G*T*A*T*A*TCC |
| SEQ ID NO: 750 | GGATATACTTTTTATTTTTGATATATATATATATTTTTATTTTT<br>ATA*T*A*T*A*T*A*T*A*T*C*G*T*A*T*A*TCC |
| SEQ ID NO: 751 | GGATATACTTTTTATTTTTGATATATGTATATATTTTTATTTTT<br>ATA*T*A*C*A*T*A*T*A*T*C*G*T*A*T*A*TCC |
| SEQ ID NO: 752 | GGTGATACTTTTTATTTTTTATATATATATATATTTTTATTTTT<br>ATA*T*A*T*A*T*A*T*A*T*A*G*T*A*T*C*ACC |
| SEQ ID NO: 753 | GGTGATACTTTTTATTTTTGATATATATATATATTTTTATTTTT<br>ATA*T*A*T*A*T*A*T*A*T*C*G*T*A*T*C*ACC |
| SEQ ID NO: 754 | GGTGATACTTTTTATTTTTGATATATGTATATATTTTTATTTTT<br>ATA*T*A*C*A*T*A*T*A*T*C*G*T*A*T*C*ACC |
| SEQ ID NO: 755 | GGTGATCCTTTTTATTTTTTATATATATATATATTTTTATTTTT<br>ATA*T*A*T*A*T*A*T*A*T*A*G*G*A*T*C*ACC |
| SEQ ID NO: 756 | GGTGATCCTTTTTATTTTTGATATATATATATATTTTTATTTTT<br>ATA*T*A*T*A*T*A*T*A*T*C*G*G*A*T*C*ACC |
| SEQ ID NO: 757 | GGTGATCCTTTTTATTTTTGATATATGTATATATTTTTATTTTT<br>ATA*T*A*C*A*T*A*T*A*T*C*G*G*A*T*C*ACC |
| SEQ ID NO: 758 | GATATATCACTTTTTATTTTTTATATATATATATATTTTTATTT<br>TTATA*T*A*T*A*T*A*T*A*T*A*G*T*G*A*T*ATATC |
| SEQ ID NO: 759 | GTATATACATTTTTTATTTTTGATATATATATATATTTTTATTT<br>TTATA*T*A*T*A*T*A*T*A*T*C*A*T*G*T*A*TATAC |
| SEQ ID NO: 760 | GTATATACATTTTTTATTTTTGATATATGTATATATTTTTATTT<br>TTATA*T*A*C*A*T*A*T*A*T*C*A*T*G*T*A*TATAC |
| SEQ ID NO: 761 | GGATATACACTTTTTATTTTTTATATATATATATATTTTTATTT<br>TTATA*T*A*T*A*T*A*T*A*T*A*G*T*G*T*A*TATCC |

TABLE 1-continued

Nucleotide sequences of blocked nucleic acid molecules.

| SEQ ID NO: | Sequence |
|---|---|
| SEQ ID NO: 762 | GGATATACATTTTTATTTTTGATATATATATATATTTTTATTTT TTATA*T*A*T*A*T*A*T*C*A*T*G*T*A*TATCC |
| SEQ ID NO: 763 | GGATATACATTTTTATTTTTGATATGTATATATTTTTATTTT TTATA*T*A*C*A*T*A*T*A*T*C*A*T*G*T*A*TATCC |
| SEQ ID NO: 764 | GGGTATATACTTTTTATTTTTTATATATATATATTTTTATTTT TTATA*T*A*T*A*T*A*T*A*T*A*G*T*A*T*A*TACCC |
| SEQ ID NO: 765 | GGATATACACTTTTTATTTTTGATATATATATATATTTTTATTTT TTATA*T*A*T*A*T*A*T*A*T*C*G*T*G*T*A*TATCC |
| SEQ ID NO: 766 | GGATATACACTTTTTATTTTTGATATGTATATATTTTTATTTT TTATA*T*A*C*A*T*A*T*A*T*C*G*T*G*T*A*TATCC |
| SEQ ID NO: 767 | GGGTATATACTTTTTATTTTTGATATATATATATATTTTTATTTT TTATA*T*A*T*A*T*A*T*A*T*C*G*T*A*T*A*TACCC |
| SEQ ID NO: 768 | GGGTATATACTTTTTATTTTTGATATGTATATATTTTTATTTT TTATA*T*A*C*A*T*A*T*A*T*C*G*T*A*T*A*TACCC |
| SEQ ID NO: 769 | GATATATCACTTTTTATTTTTTATATATATATATTTTTATTTTT ATAT*A*T*A*T*A*T*A*T*A*G*T*G*A*T*A*TATC |
| SEQ ID NO: 770 | GTATATACATTTTTATTTTTGATATATATATATTTTTATTTTT ATAT*A*T*A*T*A*T*A*T*C*A*T*G*T*A*T*ATAC |
| SEQ ID NO: 771 | GTATATACATTTTTATTTTTGATATGTATATTTTTATTTTT ATAT*A*C*A*T*A*T*A*T*C*A*T*G*T*A*T*ATAC |
| SEQ ID NO: 772 | GGATATACACTTTTTATTTTTTATATATATATATTTTTATTTTT ATAT*A*T*A*T*A*T*A*T*A*G*T*G*T*A*T*ATCC |
| SEQ ID NO: 773 | GGATATACATTTTTATTTTTGATATATATATATTTTTATTTTT ATAT*A*T*A*T*A*T*A*T*C*A*T*G*T*A*T*ATCC |
| SEQ ID NO: 774 | GGATATACATTTTTATTTTTGATATGTATATTTTTATTTTT ATAT*A*C*A*T*A*T*A*T*C*A*T*G*T*A*T*ATCC |
| SEQ ID NO: 775 | GGGTATATACTTTTTATTTTTTATATATATATATTTTTATTTTT ATAT*A*T*A*T*A*T*A*T*A*G*T*A*T*A*T*ACCC |
| SEQ ID NO: 776 | GGATATACACTTTTTATTTTTGATATATATATATTTTTATTTTT ATAT*A*T*A*T*A*T*A*T*C*G*T*G*T*A*T*ATCC |
| SEQ ID NO: 777 | GGATATACACTTTTTATTTTTGATATGTATATTTTTATTTTT ATAT*A*C*A*T*A*T*A*T*C*G*T*G*T*A*T*ATCC |
| SEQ ID NO: 778 | GGGTATATACTTTTTATTTTTGATATATATATATTTTTATTTTT ATAT*A*T*A*T*A*T*A*T*C*G*T*A*T*A*T*ACCC |
| SEQ ID NO: 779 | GGGTATATACTTTTTATTTTTGATATGTATATTTTTATTTTT ATAT*A*C*A*T*A*T*A*T*C*G*T*A*T*A*T*ACCC |
| SEQ ID NO: 780 | GATATATCACTTTTTATTTTTTATATATATATATTTTTATTTTT ATA*T*A*T*A*T*A*T*A*G*T*G*A*T*A*T*ATC |
| SEQ ID NO: 781 | GTATATACATTTTTATTTTTGATATATATATATTTTTATTTTT ATA*T*A*T*A*T*A*T*C*A*T*G*T*A*T*A*TAC |
| SEQ ID NO: 782 | GTATATACATTTTTATTTTTGATATGTATATTTTTATTTTT ATA*C*A*T*A*T*A*T*C*A*T*G*T*A*T*A*TAC |
| SEQ ID NO: 783 | GTATATACATTTTTATTTTTGATCATGTATATTTTTATTTTTA TAT*A*C*A*T*G*A*T*C*A*T*G*T*A*T*A*TAC |
| SEQ ID NO: 784 | GTATATACATTTTTATTTTTGATCATATATGTTTTTATTTTTA CAT*A*T*A*T*G*A*T*C*A*T*G*T*A*T*A*TAC |
| SEQ ID NO: 785 | GGATATACACTTTTTATTTTTTATATATATATATTTTTATTTTT ATA*T*A*T*A*T*A*T*A*G*T*G*T*A*T*A*TCC |
| SEQ ID NO: 786 | GGATATACATTTTTATTTTTGATATATATATATTTTTATTTTT ATA*T*A*T*A*T*A*T*C*A*T*G*T*A*T*A*TCC |

TABLE 1-continued

Nucleotide sequences of blocked nucleic acid molecules.

| SEQ ID NO: | Sequence |
|---|---|
| SEQ ID NO: 787 | GGATATACATTTTTTATTTTTGATATATGTATATTTTTATTTTTT<br>ATA*C*A*T*A*T*A*T*C*A*T*G*T*A*T*A*TCC |
| SEQ ID NO: 788 | GGATATACATTTTTTATTTTTGATCATGTATATTTTTTATTTTTA<br>TAT*A*C*A*T*G*A*T*C*A*T*G*T*A*T*A*TCC |
| SEQ ID NO: 789 | GGATATACATTTTTTATTTTTGATCATATATGTTTTTTATTTTTA<br>CAT*A*T*A*T*G*A*T*C*A*T*G*T*A*T*A*TCC |
| SEQ ID NO: 790 | GGGTATATACTTTTTATTTTTTATATATATATATTTTTATTTTTT<br>ATA*T*A*T*A*T*A*T*A*G*T*A*T*A*T*A*CCC |
| SEQ ID NO: 791 | GGATATACACTTTTTATTTTTGATATATATATATTTTTATTTTTT<br>ATA*T*A*T*A*T*A*T*C*G*T*G*T*A*T*A*TCC |
| SEQ ID NO: 792 | GGATATACACTTTTTATTTTTGATATATGTATATTTTTATTTTTT<br>ATA*C*A*T*A*T*A*T*C*G*T*G*T*A*T*A*TCC |
| SEQ ID NO: 793 | GGATATACACTTTTTATTTTTGATCATGTATATTTTTTATTTTTA<br>TAT*A*C*A*T*G*A*T*C*G*T*G*T*A*T*A*TCC |
| SEQ ID NO: 794 | GGATATACACTTTTTATTTTTGATCATATATGTTTTTTATTTTTA<br>CAT*A*T*A*T*G*A*T*C*G*T*G*T*A*T*A*TCC |
| SEQ ID NO: 795 | GGGTATATACTTTTTATTTTTGATATATATATATTTTTATTTTTT<br>ATA*T*A*T*A*T*A*T*C*G*T*A*T*A*T*A*CCC |
| SEQ ID NO: 796 | GGGTATATACTTTTTATTTTTGATATATGTATATTTTTATTTTTT<br>ATA*C*A*T*A*T*A*T*C*G*T*A*T*A*T*A*CCC |
| SEQ ID NO: 797 | GGGTATATACTTTTTATTTTTGATCATGTATATTTTTTATTTTTA<br>TAT*A*C*A*T*G*A*T*C*G*T*A*T*A*T*A*CCC |
| SEQ ID NO: 798 | GGGTATATACTTTTTATTTTTGATCATATATGTTTTTTATTTTTA<br>CAT*A*T*A*T*G*A*T*C*G*T*A*T*A*T*A*CCC |
| SEQ ID NO: 799 | GTACATATATTTTTTATTTTTGATATATATATATTTTTATTTTTA<br>TA*T*A*T*A*T*C*A*A*T*A*T*A*T*G*T*AC |
| SEQ ID NO: 800 | GTACATATATTTTTTATTTTTGATATATGTATTTTTATTTTTTA<br>CA*T*A*T*A*T*C*A*A*T*A*T*A*T*G*T*AC |
| SEQ ID NO: 801 | GTACATATATTTTTTATTTTTGATCATGTATTTTTTATTTTTAT<br>AC*A*T*G*A*T*C*A*A*T*A*T*A*T*G*T*AC |
| SEQ ID NO: 802 | GTACATATATTTTTTATTTTTGATCATATATTTTTTATTTTTAT<br>AT*A*T*G*A*T*C*A*A*T*A*T*A*T*G*T*AC |
| SEQ ID NO: 803 | GATGTATATACTTTTTATTTTTTATATATATATTTTTATTTTTA<br>TA*T*A*T*A*T*A*G*T*A*T*A*T*A*C*A*TC |
| SEQ ID NO: 804 | GGTACATATATTTTTTATTTTTGATATATATATATTTTTATTTTTA<br>TA*T*A*T*A*T*C*A*T*A*T*A*T*G*T*A*CC |
| SEQ ID NO: 805 | GGTACATATATTTTTTATTTTTGATATATGTATTTTTATTTTTTA<br>CA*T*A*T*A*T*C*A*T*A*T*A*T*G*T*A*CC |
| SEQ ID NO: 806 | GGTACATATATTTTTTATTTTTGATCATGTATTTTTTATTTTTAT<br>AC*A*T*G*A*T*C*A*T*A*T*A*T*G*T*A*CC |
| SEQ ID NO: 807 | GGTACATATATTTTTTATTTTTGATCATATATTTTTTATTTTTAT<br>AT*A*T*G*A*T*C*A*T*A*T*A*T*G*T*A*CC |
| SEQ ID NO: 808 | CGATCATATATTTTTTATTTTTGATATATATATTTTTATTTTTT<br>ATA*T*A*T*A*T*C*A*A*T*A*T*A*T*G*A*TCG |
| SEQ ID NO: 809 | CGATCATATATTTTTTATTTTTGATATATGTATTTTTATTTTTT<br>ACA*T*A*T*A*T*C*A*A*T*A*T*A*T*G*A*TCG |
| SEQ ID NO: 810 | CGATCATATATTTTTTATTTTTGATCATGTATTTTTTATTTTTA<br>TAC*A*T*G*A*T*C*A*A*T*A*T*A*T*G*A*TCG |
| SEQ ID NO: 811 | CGATCATATATTTTTTATTTTTGATCATATATTTTTTATTTTTA<br>TAT*A*T*G*A*T*C*A*A*T*A*T*A*T*G*A*TCG |

TABLE 1-continued

Nucleotide sequences of blocked nucleic acid molecules.

| SEQ ID NO: | Sequence |
| --- | --- |
| SEQ ID NO: 812 | GATACTTTTTATTTTTTATAAATATATATATTTTTATTTTTATA<br>T*A*T*A*T*A*T*A*T*A*T*A*G*T*A*T*C |
| SEQ ID NO: 813 | GACACTTTTTATTTTTTATAAATATATATATTTTTATTTTTATA<br>T*A*T*A*T*A*T*A*T*A*T*A*G*T*G*T*C |
| SEQ ID NO: 814 | GATACTTTTTATTTTTGATAAATATATATATTTTTATTTTTATA<br>T*A*T*A*T*A*T*A*T*A*T*C*G*T*A*T*C |
| SEQ ID NO: 815 | GATACTTTTTATTTTTGATAAATGTATATATTTTTATTTTTATA<br>T*A*T*A*C*A*T*A*T*A*T*C*G*T*A*T*C |
| SEQ ID NO: 816 | GATACTTTTTATTTTTGATGATGTATATATATTTTTATTTTTAT<br>A*T*A*T*A*C*A*T*G*A*T*C*G*T*A*T*C |
| SEQ ID NO: 817 | GATACTTTTTATTTTTGATGATATATGTACTTTTTATTTTTAGT<br>A*C*A*T*A*T*A*T*G*A*T*C*G*T*A*T*C |
| SEQ ID NO: 818 | GGATCTTTTTATTTTTTATAAATATATATATTTTTATTTTTATA<br>T*A*T*A*T*A*T*A*T*A*T*A*G*A*T*C*C |
| SEQ ID NO: 819 | GACACTTTTTATTTTTGATAAATATATATATTTTTATTTTTATA<br>T*A*T*A*T*A*T*A*T*A*T*C*G*T*G*T*C |
| SEQ ID NO: 820 | GACACTTTTTATTTTTGATAAATGTATATATTTTTATTTTTATA<br>T*A*T*A*C*A*T*A*T*A*T*C*G*T*G*T*C |
| SEQ ID NO: 821 | GACACTTTTTATTTTTGATGATGTATATATATTTTTATTTTTAT<br>A*T*A*T*A*C*A*T*G*A*T*C*G*T*G*T*C |
| SEQ ID NO: 822 | GACACTTTTTATTTTTGATGATATATGTACTTTTTATTTTTAGT<br>A*C*A*T*A*T*A*T*G*A*T*C*G*T*G*T*C |
| SEQ ID NO: 823 | GGATCTTTTTATTTTTGATAAATATATATATTTTTATTTTTATA<br>T*A*T*A*T*A*T*A*T*A*T*C*G*A*T*C*C |
| SEQ ID NO: 824 | GGATCTTTTTATTTTTGATAAATGTATATATTTTTATTTTTATA<br>T*A*T*A*C*A*T*A*T*A*T*C*G*A*T*C*C |
| SEQ ID NO: 825 | GGATCTTTTTATTTTTGATGATGTATATATATTTTTATTTTTAT<br>A*T*A*T*A*C*A*T*G*A*T*C*G*A*T*C*C |
| SEQ ID NO: 826 | GGATCTTTTTATTTTTGATGATATATGTACTTTTTATTTTTAGT<br>A*C*A*T*A*T*A*T*G*A*T*C*G*A*T*C*C |
| SEQ ID NO: 827 | GCGTCTTTTTATTTTTTATAAATATATATATTTTTATTTTTATA<br>T*A*T*A*T*A*T*A*T*A*T*A*G*A*C*G*C |
| SEQ ID NO: 828 | GCGTCTTTTTATTTTTGATAAATATATATATTTTTATTTTTATA<br>T*A*T*A*T*A*T*A*T*A*T*C*G*A*C*G*C |
| SEQ ID NO: 829 | GCGTCTTTTTATTTTTGATAAATGTATATATTTTTATTTTTATA<br>T*A*T*A*C*A*T*A*T*A*T*C*G*A*C*G*C |
| SEQ ID NO: 830 | GCGTCTTTTTATTTTTGATGATGTATATATATTTTTATTTTTAT<br>A*T*A*T*A*C*A*T*G*A*T*C*G*A*C*G*C |
| SEQ ID NO: 831 | GCGTCTTTTTATTTTTGATGATATATGTACTTTTTATTTTTAGT<br>A*C*A*T*A*T*A*T*G*A*T*C*G*A*C*G*C |
| SEQ ID NO: 832 | GTATACTTTTTATTTTTGATAAATATATATATTTTTATTTTTAT<br>A*T*A*T*A*T*A*T*A*T*C*G*T*A*T*A*C |
| SEQ ID NO: 833 | GTATACTTTTTATTTTTGATAAATGTATATATTTTTATTTTTAT<br>A*T*A*C*A*T*A*T*A*T*C*G*T*A*T*A*C |
| SEQ ID NO: 834 | GTATACTTTTTATTTTTGATGATGTATATATTTTTATTTTTATA<br>T*A*T*A*C*A*T*G*A*T*C*G*T*A*T*A*C |
| SEQ ID NO: 835 | GTATACTTTTTATTTTTGATGATATATGTACTTTTTATTTTTGTA<br>C*A*T*A*T*A*T*G*A*T*C*G*T*A*T*A*C |
| SEQ ID NO: 836 | GTGATCTTTTTATTTTTGATAAATATATATATTTTTATTTTTAT<br>A*T*A*T*A*T*A*T*A*T*C*G*A*T*C*A*C |

TABLE 1-continued

Nucleotide sequences of blocked nucleic acid molecules.

| SEQ ID NO: | Sequence |
| --- | --- |
| SEQ ID NO: 837 | GTGATCTTTTTATTTTTGATAAATGTATATATTTTTATTTTTTAT<br>A*T*A*C*A*T*A*T*A*T*C*G*A*T*C*A*C |
| SEQ ID NO: 838 | GTGATCTTTTTATTTTTGATGATGTATATATTTTTATTTTTATA<br>T*A*T*A*C*A*T*G*A*T*C*G*A*T*C*A*C |
| SEQ ID NO: 839 | GTGATCTTTTTATTTTTGATGATATATGTACTTTTTATTTTTGTA<br>C*A*T*A*T*A*T*G*A*T*C*G*A*T*C*A*C |
| SEQ ID NO: 840 | GGATACTTTTTATTTTTGATAAATATATATATTTTTATTTTTTAT<br>A*T*A*T*A*T*A*T*A*T*C*G*T*A*T*C*C |
| SEQ ID NO: 841 | GGATACTTTTTATTTTTGATAAATGTATATATTTTTATTTTTTAT<br>A*T*A*C*A*T*A*T*A*T*C*G*T*A*T*C*C |
| SEQ ID NO: 842 | GGATACTTTTTATTTTTGATGATGTATATATTTTTATTTTTATA<br>T*A*T*A*C*A*T*G*A*T*C*G*T*A*T*C*C |
| SEQ ID NO: 843 | GGATACTTTTTATTTTTGATGATATATGTACTTTTTATTTTTGTA<br>C*A*T*A*T*A*T*G*A*T*C*G*T*A*T*C*C |
| SEQ ID NO: 844 | GCGATCTTTTTATTTTTGATAAATATATATATTTTTATTTTTTAT<br>A*T*A*T*A*T*A*T*A*T*C*G*A*T*C*G*C |
| SEQ ID NO: 845 | GCGATCTTTTTATTTTTGATAAATGTATATATTTTTATTTTTTAT<br>A*T*A*C*A*T*A*T*A*T*C*G*A*T*C*G*C |
| SEQ ID NO: 846 | GCGATCTTTTTATTTTTGATGATGTATATATTTTTATTTTTATA<br>T*A*T*A*C*A*T*G*A*T*C*G*A*T*C*G*C |
| SEQ ID NO: 847 | GCGATCTTTTTATTTTTGATGATATATGTACTTTTTATTTTTGTA<br>C*A*T*A*T*A*T*G*A*T*C*G*A*T*C*G*C |
| SEQ ID NO: 848 | GATATACTTTTTATTTTTTATAAATATATATTTTTATTTTTATA<br>T*A*T*A*T*A*T*A*T*A*G*T*A*T*A*T*C |
| SEQ ID NO: 849 | GATATATTTTTTATTTTTGATAAATGTATATTTTTATTTTTATA<br>T*A*C*A*T*A*T*A*T*C*A*T*A*T*A*T*C |
| SEQ ID NO: 850 | GATATATTTTTTATTTTTGATGATGTATATATTTTTATTTTTTAT<br>A*T*A*C*A*T*G*A*T*C*A*T*A*T*A*T*C |
| SEQ ID NO: 851 | GATATATTTTTTATTTTTGATGATATATGTATTTTTATTTTTTAC<br>A*T*A*T*A*T*G*A*T*C*A*T*A*T*A*T*C |
| SEQ ID NO: 852 | GTGATACTTTTTATTTTTTATAAATATATATTTTTATTTTTATA<br>T*A*T*A*T*A*T*A*T*A*G*T*A*T*C*A*C |
| SEQ ID NO: 853 | GATATACTTTTTATTTTTGATAAATATATATTTTTATTTTTATA<br>T*A*T*A*T*A*T*A*T*C*G*T*A*T*A*T*C |
| SEQ ID NO: 854 | GATATACTTTTTATTTTTGATGATGTATATATTTTTATTTTTTAT<br>A*T*A*C*A*T*G*A*T*C*G*T*A*T*A*T*C |
| SEQ ID NO: 855 | GATATACTTTTTATTTTTGATGATATATGTATTTTTATTTTTTAC<br>A*T*A*T*A*T*G*A*T*C*G*T*A*T*A*T*C |
| SEQ ID NO: 856 | GGTATACTTTTTATTTTTTATAAATATATATTTTTATTTTTATA<br>T*A*T*A*T*A*T*A*T*A*G*T*A*T*A*C*C |
| SEQ ID NO: 857 | GTGATACTTTTTATTTTTGATAAATATATATTTTTATTTTTATA<br>T*A*T*A*T*A*T*A*T*C*G*T*A*T*C*A*C |
| SEQ ID NO: 858 | GTGATACTTTTTATTTTTGATAAATGTATATTTTTATTTTTATA<br>T*A*C*A*T*A*T*A*T*C*G*T*A*T*C*A*C |
| SEQ ID NO: 859 | GTGATACTTTTTATTTTTGATGATGTATATATTTTTATTTTTTAT<br>A*T*A*C*A*T*G*A*T*C*G*T*A*T*C*A*C |
| SEQ ID NO: 860 | GTGATACTTTTTATTTTTGATGATATATGTATTTTTATTTTTTAC<br>A*T*A*T*A*T*G*A*T*C*G*T*A*T*C*A*C |
| SEQ ID NO: 861 | GGTATACTTTTTATTTTTGATAAATATATATATTTTTATTTTTATA<br>T*A*T*A*T*A*T*A*T*C*G*T*A*T*A*C*C |

TABLE 1-continued

Nucleotide sequences of blocked nucleic acid molecules.

| SEQ ID NO: | Sequence |
|---|---|
| SEQ ID NO: 862 | GGTATACTTTTTATTTTTGATAAATGTATATTTTTATTTTTATA<br>T*A*C*A*T*A*T*A*T*C*G*T*A*T*A*C*C |
| SEQ ID NO: 863 | GGTATACTTTTTATTTTTGATGATGTATATATTTTTATTTTTAT<br>A*T*A*C*A*T*G*A*T*C*G*T*A*T*A*C*C |
| SEQ ID NO: 864 | GGTATACTTTTTATTTTTGATGATATATGTATTTTTATTTTTAC<br>A*T*A*T*A*T*G*A*T*C*G*T*A*T*A*C*C |
| SEQ ID NO: 865 | GGTGTACTTTTTATTTTTTATAAATATATATTTTTATTTTTATA<br>T*A*T*A*T*A*T*A*T*A*G*T*A*C*A*C*C |
| SEQ ID NO: 866 | GGTGTACTTTTTATTTTTGATAAATATATATTTTTATTTTTATA<br>T*A*T*A*T*A*T*A*T*C*G*T*A*C*A*C*C |
| SEQ ID NO: 867 | GGTGTACTTTTTATTTTTGATAAATGTATATTTTTATTTTTATA<br>T*A*C*A*T*A*T*A*T*C*G*T*A*C*A*C*C |
| SEQ ID NO: 868 | GGTGTACTTTTTATTTTTGATGATGTATATATTTTTATTTTTAT<br>A*T*A*C*A*T*G*A*T*C*G*T*A*C*A*C*C |
| SEQ ID NO: 869 | GGTGTACTTTTTATTTTTGATGATATATGTATTTTTATTTTTAC<br>A*T*A*T*A*T*G*A*T*C*G*T*A*C*A*C*C |
| SEQ ID NO: 870 | GTATATACTTTTTATTTTTGATAAATATATATTTTTATTTTTAT<br>A*T*A*T*A*T*A*T*C*G*T*A*T*A*T*A*C |
| SEQ ID NO: 871 | GTATATACTTTTTATTTTTGATAAATGTATATTTTTATTTTTAT<br>A*C*A*T*A*T*A*T*C*G*T*A*T*A*T*A*C |
| SEQ ID NO: 872 | GTATATACTTTTTATTTTTGATGATGTATATTTTTATTTTTATA<br>T*A*C*A*T*G*A*T*C*G*T*A*T*A*T*A*C |
| SEQ ID NO: 873 | GTATATACTTTTTATTTTTGATGATATATGTTTTTTATTTTTACA<br>T*A*T*A*T*G*A*T*C*G*T*A*T*A*T*A*C |
| SEQ ID NO: 874 | GGATATACTTTTTATTTTTGATAAATATATATTTTTATTTTTAT<br>A*T*A*T*A*T*A*T*C*G*T*A*T*A*T*C*C |
| SEQ ID NO: 875 | GGATATACTTTTTATTTTTGATAAATGTATATTTTTATTTTTAT<br>A*C*A*T*A*T*A*T*C*G*T*A*T*A*T*C*C |
| SEQ ID NO: 876 | GGATATACTTTTTATTTTTGATGATGTATATTTTTATTTTTATA<br>T*A*C*A*T*G*A*T*C*G*T*A*T*A*T*C*C |
| SEQ ID NO: 877 | GGATATACTTTTTATTTTTGATGATATATGTTTTTTATTTTTACA<br>T*A*T*A*T*G*A*T*C*G*T*A*T*A*T*C*C |
| SEQ ID NO: 878 | GGTGATACTTTTTATTTTTGATAAATATATATTTTTATTTTTAT<br>A*T*A*T*A*T*A*T*C*G*T*A*T*C*A*C*C |
| SEQ ID NO: 879 | GGTGATACTTTTTATTTTTGATAAATGTATATTTTTATTTTTAT<br>A*C*A*T*A*T*A*T*C*G*T*A*T*C*A*C*C |
| SEQ ID NO: 880 | GGTGATACTTTTTATTTTTGATGATGTATATTTTTATTTTTATA<br>T*A*C*A*T*G*A*T*C*G*T*A*T*C*A*C*C |
| SEQ ID NO: 881 | GGTGATACTTTTTATTTTTGATGATATATGTTTTTTATTTTTACA<br>T*A*T*A*T*G*A*T*C*G*T*A*T*C*A*C*C |
| SEQ ID NO: 882 | GGTGATCCTTTTTATTTTTGATAAATATATATTTTTATTTTTAT<br>A*T*A*T*A*T*A*T*C*G*G*A*T*C*A*C*C |
| SEQ ID NO: 883 | GGTGATCCTTTTTATTTTTGATAAATGTATATTTTTATTTTTAT<br>A*C*A*T*A*T*A*T*C*G*G*A*T*C*A*C*C |
| SEQ ID NO: 884 | GGTGATCCTTTTTATTTTTGATGATGTATATTTTTATTTTTATA<br>T*A*C*A*T*G*A*T*C*G*G*A*T*C*A*C*C |
| SEQ ID NO: 885 | GGTGATCCTTTTTATTTTTGATGATATATGTTTTTTATTTTTACA<br>T*A*T*A*T*G*A*T*C*G*G*A*T*C*A*C*C |
| SEQ ID NO: 886 | GTATATACATTTTTTATTTTTGATAAATATATTTTTATTTTTAT<br>A*T*A*T*A*T*C*A*T*G*T*A*T*A*T*A*C |

TABLE 1-continued

Nucleotide sequences of blocked nucleic acid molecules.

| SEQ ID NO: | Sequence |
| --- | --- |
| SEQ ID NO: 887 | GTATATACATTTTTATTTTTGATAAATGTATTTTTATTTTTAC<br>A*T*A*T*A*T*C*A*T*G*T*A*T*A*T*A*C |
| SEQ ID NO: 888 | GTATATACATTTTTATTTTTGATGATGTATTTTTATTTTTATA<br>C*A*T*G*A*T*C*A*T*G*T*A*T*A*T*A*C |
| SEQ ID NO: 889 | GTATATACATTTTTATTTTTGATGATATATTTTTATTTTTATA<br>T*A*T*G*A*T*C*A*T*G*T*A*T*A*T*A*C |
| SEQ ID NO: 890 | GGATATACATTTTTATTTTTGATAAATATATTTTTATTTTTAT<br>A*T*A*T*A*T*C*A*T*G*T*A*T*A*T*C*C |
| SEQ ID NO: 891 | GGATATACATTTTTATTTTTGATAAATGTATTTTTATTTTTAC<br>A*T*A*T*A*T*C*A*T*G*T*A*T*A*T*C*C |
| SEQ ID NO: 892 | GGATATACATTTTTATTTTTGATGATGTATTTTTATTTTTATA<br>C*A*T*G*A*T*C*A*T*G*T*A*T*A*T*C*C |
| SEQ ID NO: 893 | GGATATACATTTTTATTTTTGATGATATATTTTTATTTTTATA<br>T*A*T*G*A*T*C*A*T*G*T*A*T*A*T*C*C |
| SEQ ID NO: 894 | GGATATACACTTTTTATTTTTGATAAATATATTTTTATTTTTAT<br>A*T*A*T*A*T*C*G*T*G*T*A*T*A*T*C*C |
| SEQ ID NO: 895 | GGATATACACTTTTTATTTTTGATAAATGTATTTTTATTTTTAC<br>A*T*A*T*A*T*C*G*T*G*T*A*T*A*T*C*C |
| SEQ ID NO: 896 | GGATATACACTTTTTATTTTTGATGATGTATTTTTATTTTTATA<br>C*A*T*G*A*T*C*G*T*G*T*A*T*A*T*C*C |
| SEQ ID NO: 897 | GGATATACACTTTTTATTTTTGATGATATATTTTTATTTTTATA<br>T*A*T*G*A*T*C*G*T*G*T*A*T*A*T*C*C |
| SEQ ID NO: 898 | GGGTATATACTTTTTATTTTTGATAAATATATTTTTATTTTTAT<br>A*T*A*T*A*T*C*G*T*A*T*A*T*A*C*C*C |
| SEQ ID NO: 899 | GGGTATATACTTTTTATTTTTGATAAATGTATTTTTATTTTTAC<br>A*T*A*T*A*T*C*G*T*A*T*A*T*A*C*C*C |
| SEQ ID NO: 900 | GGGTATATACTTTTTATTTTTGATGATGTATTTTTATTTTTATA<br>C*A*T*G*A*T*C*G*T*A*T*A*T*A*C*C*C |
| SEQ ID NO: 901 | GGGTATATACTTTTTATTTTTGATGATATATTTTTATTTTTATA<br>T*A*T*G*A*T*C*G*T*A*T*A*T*A*C*C*C |
| SEQ ID NO: 902 | GGATGTACACTTTTTATTTTTGATAAATATATTTTTATTTTTAT<br>A*T*A*T*A*T*C*G*T*G*T*A*C*A*T*C*C |
| SEQ ID NO: 903 | GGATGTACACTTTTTATTTTTGATAAATGTATTTTTATTTTTAC<br>A*T*A*T*A*T*C*G*T*G*T*A*C*A*T*C*C |
| SEQ ID NO: 904 | GGATGTACACTTTTTATTTTTGATGATGTATTTTTATTTTTATA<br>C*A*T*G*A*T*C*G*T*G*T*A*C*A*T*C*C |
| SEQ ID NO: 905 | GGATGTACACTTTTTATTTTTGATGATATATTTTTATTTTTATA<br>T*A*T*G*A*T*C*G*T*G*T*A*C*A*T*C*C |
| SEQ ID NO: 906 | GTATATACTTTTTATTTTTTATAAATATATATATTTTTTATTTTT<br>ATAT*A*T*A*T*A*T*A*T*A*G*T*A*T*ATAC |
| SEQ ID NO: 907 | GTATATACTTTTTATTTTTGATAAATATATATATTTTTATTTTT<br>ATAT*A*T*A*T*A*T*A*T*C*G*T*A*T*ATAC |
| SEQ ID NO: 908 | GTATATACTTTTTATTTTTGATAAATGTATATATTTTTATTTTT<br>ATAT*A*T*A*C*A*T*A*T*A*T*C*G*T*A*T*ATAC |
| SEQ ID NO: 909 | GTATATACTTTTTATTTTTGATGATGTATATATATTTTTATTTTT<br>TATA*T*A*T*A*C*A*T*G*A*T*C*G*T*A*T*ATAC |
| SEQ ID NO: 910 | GTATATACTTTTTATTTTTGATGATATATGTACTTTTTATTTTT<br>AGTA*C*A*T*A*T*A*T*G*A*T*C*G*T*A*T*ATAC |
| SEQ ID NO: 911 | GGATATACTTTTTATTTTTTATAAATATATATATTTTTTATTTTT<br>ATAT*A*T*A*T*A*T*A*T*A*T*A*G*T*A*T*ATCC |

TABLE 1-continued

Nucleotide sequences of blocked nucleic acid molecules.

| SEQ ID NO: | Sequence |
|---|---|
| SEQ ID NO: 912 | GGATATACTTTTTATTTTTGATAAATATATATATTTTTTATTTT<br>ATAT*A*T*A*T*A*T*A*T*C*G*T*A*T*ATCC |
| SEQ ID NO: 913 | GGATATACTTTTTATTTTTGATAAATGTATATATTTTTTATTTT<br>ATAT*A*T*A*C*A*T*A*T*A*T*C*G*T*A*T*ATCC |
| SEQ ID NO: 914 | GGATATACTTTTTATTTTTGATGATGTATATATATTTTTATTTT<br>TATA*T*A*T*A*C*A*T*G*A*T*C*G*T*A*T*ATCC |
| SEQ ID NO: 915 | GGATATACTTTTTATTTTTGATGATATATGTACTTTTTTATTTT<br>AGTA*C*A*T*A*T*A*T*G*A*T*C*G*T*A*T*ATCC |
| SEQ ID NO: 916 | GGTGATACTTTTTATTTTTTATAAATATATATATTTTTTATTTT<br>ATAT*A*T*A*T*A*T*A*T*A*T*A*G*T*A*T*CACC |
| SEQ ID NO: 917 | GGTGATACTTTTTATTTTTGATAAATATATATATTTTTTATTTT<br>ATAT*A*T*A*T*A*T*A*T*A*T*C*G*T*A*T*CACC |
| SEQ ID NO: 918 | GGTGATACTTTTTATTTTTGATAAATGTATATATTTTTTATTTT<br>ATAT*A*T*A*C*A*T*A*T*A*T*C*G*T*A*T*CACC |
| SEQ ID NO: 919 | GGTGATACTTTTTATTTTTGATGATGTATATATATTTTTATTTT<br>TATA*T*A*T*A*C*A*T*G*A*T*C*G*T*A*T*CACC |
| SEQ ID NO: 920 | GGTGATACTTTTTATTTTTGATGATATATGTACTTTTTTATTTT<br>AGTA*C*A*T*A*T*A*T*G*A*T*C*G*T*A*T*CACC |
| SEQ ID NO: 921 | GGTGATCCTTTTTATTTTTTATAAATATATATATTTTTTATTTT<br>ATAT*A*T*A*T*A*T*A*T*A*T*A*G*G*A*T*CACC |
| SEQ ID NO: 922 | GGTGATCCTTTTTATTTTTGATAAATATATATATTTTTTATTTT<br>ATAT*A*T*A*T*A*T*A*T*A*T*C*G*G*A*T*CACC |
| SEQ ID NO: 923 | GGTGATCCTTTTTATTTTTGATAAATGTATATATTTTTTATTTT<br>ATAT*A*T*A*C*A*T*A*T*A*T*C*G*G*A*T*CACC |
| SEQ ID NO: 924 | GGTGATCCTTTTTATTTTTGATGATGTATATATATTTTTATTTT<br>TATA*T*A*T*A*C*A*T*G*A*T*C*G*G*A*T*CACC |
| SEQ ID NO: 925 | GGTGATCCTTTTTATTTTTGATGATATATGTACTTTTTTATTTT<br>AGTA*C*A*T*A*T*A*T*G*A*T*C*G*G*A*T*CACC |
| SEQ ID NO: 926 | GATATATCACTTTTTATTTTTTATAAATATATATATTTTTTATTT<br>TTATAT*A*T*A*T*A*T*A*T*A*T*A*G*T*G*A*TATATC |
| SEQ ID NO: 927 | GTATATACATTTTTTATTTTTGATAAATATATATATTTTTTATTT<br>TTATAT*A*T*A*T*A*T*A*T*A*T*C*A*T*G*T*ATATAC |
| SEQ ID NO: 928 | GTATATACATTTTTTATTTTTGATAAATGTATATATTTTTTATTT<br>TTATAT*A*T*A*C*A*T*A*T*A*T*C*A*T*G*T*ATATAC |
| SEQ ID NO: 929 | GTATATACATTTTTTATTTTTGATGATGTATATATATTTTTATTT<br>TTTATA*T*A*T*A*C*A*T*G*A*T*C*A*T*G*T*ATATAC |
| SEQ ID NO: 930 | GTATATACATTTTTTATTTTTGATGATATATGTACTTTTTTATTT<br>TTAGTA*C*A*T*A*T*A*T*G*A*T*C*A*T*G*T*ATATAC |
| SEQ ID NO: 931 | GGATATACACTTTTTATTTTTTATAAATATATATATTTTTTATTT<br>TTATAT*A*T*A*T*A*T*A*T*A*T*A*G*T*G*T*ATATCC |
| SEQ ID NO: 932 | GGATATACATTTTTTATTTTTGATAAATATATATATTTTTTATTT<br>TTATAT*A*T*A*T*A*T*A*T*A*T*C*A*T*G*T*ATATCC |
| SEQ ID NO: 933 | GGATATACATTTTTTATTTTTGATAAATGTATATATTTTTTATTT<br>TTATAT*A*T*A*C*A*T*A*T*A*T*C*A*T*G*T*ATATCC |
| SEQ ID NO: 934 | GGATATACATTTTTTATTTTTGATGATGTATATATATTTTTATTT<br>TTTATA*T*A*T*A*C*A*T*G*A*T*C*A*T*G*T*ATATCC |
| SEQ ID NO: 935 | GGATATACATTTTTTATTTTTGATGATATATGTACTTTTTTATTT<br>TTAGTA*C*A*T*A*T*A*T*G*A*T*C*A*T*G*T*ATATCC |
| SEQ ID NO: 936 | GGGTATATACTTTTTATTTTTTATAAATATATATATTTTTTATTT<br>TTATAT*A*T*A*T*A*T*A*T*A*T*A*G*T*A*T*ATACCC |

TABLE 1-continued

Nucleotide sequences of blocked nucleic acid molecules.

| SEQ ID NO: | Sequence |
| --- | --- |
| SEQ ID NO: 937 | GGATATACACTTTTTATTTTTGATAAATATATATATTTTTTATT<br>TTTATAT*A*T*A*T*A*T*A*T*C*G*T*G*T*ATATCC |
| SEQ ID NO: 938 | GGATATACACTTTTTATTTTTGATAAATGTATATATTTTTTATT<br>TTTATAT*A*T*A*C*A*T*A*T*A*T*C*G*T*G*T*ATATCC |
| SEQ ID NO: 939 | GGATATACACTTTTTATTTTTGATGATGTATATATATTTTTTATT<br>TTTTATA*T*A*T*A*C*A*T*G*A*T*C*G*T*G*T*ATATCC |
| SEQ ID NO: 940 | GGATATACACTTTTTATTTTTGATGATATATGTACTTTTTATTT<br>TTAGTA*C*A*T*A*T*A*T*G*A*T*C*G*T*G*T*ATATCC |
| SEQ ID NO: 941 | GGGTATATACTTTTTATTTTTGATAAATATATATATTTTTTATTT<br>TTATAT*A*T*A*T*A*T*A*T*A*T*C*G*T*A*T*ATACCC |
| SEQ ID NO: 942 | GGGTATATACTTTTTATTTTTGATAAATGTATATATTTTTTATTT<br>TTATAT*A*T*A*C*A*T*A*T*A*T*C*G*T*A*T*ATACCC |
| SEQ ID NO: 943 | GGGTATATACTTTTTATTTTTGATGATGTATATATATTTTTTATTT<br>TTTATA*T*A*T*A*C*A*T*G*A*T*C*G*T*A*T*ATACCC |
| SEQ ID NO: 944 | GGGTATATACTTTTTATTTTTGATGATATATGTACTTTTTATTT<br>TTAGTA*C*A*T*A*T*A*T*G*A*T*C*G*T*A*T*ATACCC |
| SEQ ID NO: 945 | GTATATACTTTTTATTTTTGATAAATATATATATTTTTATTTTTT<br>ATA*T*A*T*A*T*A*T*A*T*C*G*T*A*T*A*TAC |
| SEQ ID NO: 946 | GTATATACTTTTTATTTTTGATAAATGTATATATTTTTATTTTTT<br>ATA*T*A*C*A*T*A*T*A*T*C*G*T*A*T*A*TAC |
| SEQ ID NO: 947 | GTATATACTTTTTATTTTTGATGATGTATATATTTTTTATTTTTA<br>TAT*A*T*A*C*A*T*G*A*T*C*G*T*A*T*A*TAC |
| SEQ ID NO: 948 | GTATATACTTTTTATTTTTGATGATATATGTACTTTTTATTTTTG<br>TAC*A*T*A*T*A*T*G*A*T*C*G*T*A*T*A*TAC |
| SEQ ID NO: 949 | GGATATACTTTTTATTTTTGATAAATATATATATTTTTATTTTTT<br>ATA*T*A*T*A*T*A*T*A*T*C*G*T*A*T*A*TCC |
| SEQ ID NO: 950 | GGATATACTTTTTATTTTTGATAAATGTATATATTTTTATTTTTT<br>ATA*T*A*C*A*T*A*T*A*T*C*G*T*A*T*A*TCC |
| SEQ ID NO: 951 | GGATATACTTTTTATTTTTGATGATGTATATATTTTTTATTTTTA<br>TAT*A*T*A*C*A*T*G*A*T*C*G*T*A*T*A*TCC |
| SEQ ID NO: 952 | GGATATACTTTTTATTTTTGATGATATATGTACTTTTTATTTTTG<br>TAC*A*T*A*T*A*T*G*A*T*C*G*T*A*T*A*TCC |
| SEQ ID NO: 953 | GGTGATACTTTTTATTTTTGATAAATATATATATTTTTATTTTTT<br>ATA*T*A*T*A*T*A*T*A*T*C*G*T*A*T*C*ACC |
| SEQ ID NO: 954 | GGTGATACTTTTTATTTTTGATAAATGTATATATTTTTATTTTTT<br>ATA*T*A*C*A*T*A*T*A*T*C*G*T*A*T*C*ACC |
| SEQ ID NO: 955 | GGTGATACTTTTTATTTTTGATGATGTATATATTTTTTATTTTTA<br>TAT*A*T*A*C*A*T*G*A*T*C*G*T*A*T*C*ACC |
| SEQ ID NO: 956 | GGTGATACTTTTTATTTTTGATGATATATGTACTTTTTATTTTTG<br>TAC*A*T*A*T*A*T*G*A*T*C*G*T*A*T*C*ACC |
| SEQ ID NO: 957 | GGTGATCCTTTTTATTTTTGATAAATATATATATTTTTATTTTTT<br>ATA*T*A*T*A*T*A*T*A*T*C*G*G*A*T*C*ACC |
| SEQ ID NO: 958 | GGTGATCCTTTTTATTTTTGATAAATGTATATATTTTTATTTTTT<br>ATA*T*A*C*A*T*A*T*A*T*C*G*G*A*T*C*ACC |
| SEQ ID NO: 959 | GGTGATCCTTTTTATTTTTGATGATGTATATATTTTTTATTTTTA<br>TAT*A*T*A*C*A*T*G*A*T*C*G*G*A*T*C*ACC |
| SEQ ID NO: 960 | GGTGATCCTTTTTATTTTTGATGATATATGTACTTTTTATTTTTG<br>TAC*A*T*A*T*A*T*G*A*T*C*G*G*A*T*C*ACC |
| SEQ ID NO: 961 | GTATATACATTTTTATTTTTGATAAATATATATATTTTTATTTT<br>TTATA*T*A*T*A*T*A*T*A*T*C*A*T*G*T*A*TATAC |

TABLE 1-continued

Nucleotide sequences of blocked nucleic acid molecules.

| SEQ ID NO: | Sequence |
| --- | --- |
| SEQ ID NO: 962 | GTATATACATTTTTTATTTTTGATGATGTATATATTTTTTATTTT<br>TATAT*A*T*A*C*A*T*G*A*T*C*A*T*G*T*A*TATAC |
| SEQ ID NO: 963 | GTATATACATTTTTTATTTTTGATGATATATGTACTTTTTATTTT<br>TGTAC*A*T*A*T*A*T*G*A*T*C*A*T*G*T*A*TATAC |
| SEQ ID NO: 964 | GGATATACATTTTTTATTTTTGATAAATATATATATTTTTTATTTT<br>TTATA*T*A*T*A*T*A*T*A*T*C*A*T*G*T*A*TATCC |
| SEQ ID NO: 965 | GGATATACATTTTTTATTTTTGATAAATGTATATATTTTTTATTTT<br>TTATA*T*A*C*A*T*A*T*A*T*C*A*T*G*T*A*TATCC |
| SEQ ID NO: 966 | GGATATACATTTTTTATTTTTGATGATGTATATATTTTTTATTTT<br>TATAT*A*T*A*C*A*T*G*A*T*C*A*T*G*T*A*TATCC |
| SEQ ID NO: 967 | GGATATACATTTTTTATTTTTGATGATATATGTACTTTTTATTTT<br>TGTAC*A*T*A*T*A*T*G*A*T*C*A*T*G*T*A*TATCC |
| SEQ ID NO: 968 | GGATATACACTTTTTATTTTTGATAAATATATATATTTTTTATTT<br>TTTATA*T*A*T*A*T*A*T*A*T*C*G*T*G*T*A*TATCC |
| SEQ ID NO: 969 | GGATATACACTTTTTATTTTTGATAAATGTATATATTTTTTATTT<br>TTTATA*T*A*C*A*T*A*T*A*T*C*G*T*G*T*A*TATCC |
| SEQ ID NO: 970 | GGATATACACTTTTTATTTTTGATGATGTATATATTTTTTATTTT<br>TATAT*A*T*A*C*A*T*G*A*T*C*G*T*G*T*A*TATCC |
| SEQ ID NO: 971 | GGATATACACTTTTTATTTTTGATGATATATGTACTTTTTATTTT<br>TGTAC*A*T*A*T*A*T*G*A*T*C*G*T*G*T*A*TATCC |
| SEQ ID NO: 972 | GGGTATATACTTTTTATTTTTGATAAATATATATATTTTTTATTTT<br>TTATA*T*A*T*A*T*A*T*A*T*C*G*T*A*T*A*TACCC |
| SEQ ID NO: 973 | GGGTATATACTTTTTATTTTTGATAAATGTATATATTTTTTATTTT<br>TTATA*T*A*C*A*T*A*T*A*T*C*G*T*A*T*A*TACCC |
| SEQ ID NO: 974 | GGGTATATACTTTTTATTTTTGATGATGTATATATTTTTTATTTT<br>TATAT*A*T*A*C*A*T*G*A*T*C*G*T*A*T*A*TACCC |
| SEQ ID NO: 975 | GGGTATATACTTTTTATTTTTGATGATATATGTACTTTTTATTTT<br>TGTAC*A*T*A*T*A*T*G*A*T*C*G*T*A*T*A*TACCC |
| SEQ ID NO: 976 | GATATATCACTTTTTATTTTTTATAAATATATATTTTTTATTTTT<br>ATAT*A*T*A*T*A*T*A*T*A*G*T*G*A*T*A*TATC |
| SEQ ID NO: 977 | GTATATACATTTTTTATTTTTGATAAATATATATATTTTTTATTTTT<br>ATAT*A*T*A*T*A*T*A*T*C*A*T*G*T*A*T*ATAC |
| SEQ ID NO: 978 | GTATATACATTTTTTATTTTTGATGATGTATATATTTTTTATTTTT<br>TATA*T*A*C*A*T*G*A*T*C*A*T*G*T*A*T*ATAC |
| SEQ ID NO: 979 | GTATATACATTTTTTATTTTTGATGATATATGTATTTTTATTTTT<br>TACA*T*A*T*A*T*G*A*T*C*A*T*G*T*A*T*ATAC |
| SEQ ID NO: 980 | GGATATACACTTTTTATTTTTTATAAATATATATATTTTTTATTTTT<br>ATAT*A*T*A*T*A*T*A*T*A*G*T*G*T*A*T*ATCC |
| SEQ ID NO: 981 | GGATATACATTTTTTATTTTTGATAAATATATATATTTTTTATTTTT<br>ATAT*A*T*A*T*A*T*A*T*C*A*T*G*T*A*T*ATCC |
| SEQ ID NO: 982 | GGATATACATTTTTTATTTTTGATAAATGTATATTTTTTATTTTT<br>ATAT*A*C*A*T*A*T*A*T*C*A*T*G*T*A*T*ATCC |
| SEQ ID NO: 983 | GGATATACATTTTTTATTTTTGATGATGTATATATTTTTTATTTTT<br>TATA*T*A*C*A*T*G*A*T*C*A*T*G*T*A*T*ATCC |
| SEQ ID NO: 984 | GGATATACATTTTTTATTTTTGATGATATATGTATTTTTATTTTT<br>TACA*T*A*T*A*T*G*A*T*C*A*T*G*T*A*T*ATCC |
| SEQ ID NO: 985 | GGGTATATACTTTTTATTTTTTATAAATATATATATTTTTTATTTTT<br>ATAT*A*T*A*T*A*T*A*T*A*G*T*A*T*A*T*ACCC |
| SEQ ID NO: 986 | GGATATACACTTTTTATTTTTGATAAATATATATATTTTTTATTTTT<br>ATAT*A*T*A*T*A*T*A*T*C*G*T*G*T*A*T*ATCC |

TABLE 1-continued

Nucleotide sequences of blocked nucleic acid molecules.

| SEQ ID NO: | Sequence |
|---|---|
| SEQ ID NO: 987 | GGATATACACTTTTTATTTTTGATAAATGTATATTTTTATTTTT<br>ATAT*A*C*A*T*A*T*A*T*C*G*T*G*T*A*T*ATCC |
| SEQ ID NO: 988 | GGATATACACTTTTTATTTTTGATGATGTATATATTTTTATTTTT<br>TATA*T*A*C*A*T*G*A*T*C*G*T*G*T*A*T*ATCC |
| SEQ ID NO: 989 | GGATATACACTTTTTATTTTTGATGATATATGTATTTTTATTTTT<br>TACA*T*A*T*A*T*G*A*T*C*G*T*G*T*A*T*ATCC |
| SEQ ID NO: 990 | GGGTATATACTTTTTATTTTTGATAAATATATATTTTTATTTTT<br>ATAT*A*T*A*T*A*T*A*T*C*G*T*A*T*A*T*ACCC |
| SEQ ID NO: 991 | GGGTATATACTTTTTATTTTTGATAAATGTATATTTTTATTTTT<br>ATAT*A*C*A*T*A*T*A*T*C*G*T*A*T*A*T*ACCC |
| SEQ ID NO: 992 | GGGTATATACTTTTTATTTTTGATGATGTATATATTTTTATTTTT<br>TATA*T*A*C*A*T*G*A*T*C*G*T*A*T*A*T*ACCC |
| SEQ ID NO: 993 | GGGTATATACTTTTTATTTTTGATGATATATGTATTTTTATTTTT<br>TACA*T*A*T*A*T*G*A*T*C*G*T*A*T*A*T*ACCC |
| SEQ ID NO: 994 | GTATATACATTTTTTATTTTTGATAAATATATATTTTTATTTTTT<br>ATA*T*A*T*A*T*A*T*C*A*T*G*T*A*T*A*TAC |
| SEQ ID NO: 995 | GTATATACATTTTTTATTTTTGATGATGTATATTTTTTATTTTTA<br>TAT*A*C*A*T*G*A*T*C*A*T*G*T*A*T*A*TAC |
| SEQ ID NO: 996 | GTATATACATTTTTTATTTTTGATGATATATGTTTTTATTTTTA<br>CAT*A*T*A*T*G*A*T*C*A*T*G*T*A*T*A*TAC |
| SEQ ID NO: 997 | GGATATACATTTTTTATTTTTGATAAATATATATTTTTATTTTTT<br>ATA*T*A*T*A*T*A*T*C*A*T*G*T*A*T*A*TCC |
| SEQ ID NO: 998 | GGATATACATTTTTTATTTTTGATAAATGTATATTTTTATTTTTT<br>ATA*C*A*T*A*T*A*T*C*A*T*G*T*A*T*A*TCC |
| SEQ ID NO: 999 | GGATATACATTTTTTATTTTTGATGATGTATATTTTTTATTTTTA<br>TAT*A*C*A*T*G*A*T*C*A*T*G*T*A*T*A*TCC |
| SEQ ID NO: 1000 | GGATATACATTTTTTATTTTTGATGATATATGTTTTTATTTTTA<br>CAT*A*T*A*T*G*A*T*C*A*T*G*T*A*T*A*TCC |
| SEQ ID NO: 1001 | GGATATACACTTTTTATTTTTGATAAATATATATTTTTATTTTTT<br>ATA*T*A*T*A*T*A*T*C*G*T*G*T*A*T*A*TCC |
| SEQ ID NO: 1002 | GGATATACACTTTTTATTTTTGATAAATGTATATTTTTATTTTTT<br>ATA*C*A*T*A*T*A*T*C*G*T*G*T*A*T*A*TCC |
| SEQ ID NO: 1003 | GGATATACACTTTTTATTTTTGATGATGTATATTTTTTATTTTTA<br>TAT*A*C*A*T*G*A*T*C*G*T*G*T*A*T*A*TCC |
| SEQ ID NO: 1004 | GGATATACACTTTTTATTTTTGATGATATATGTTTTTATTTTTA<br>CAT*A*T*A*T*G*A*T*C*G*T*G*T*A*T*A*TCC |
| SEQ ID NO: 1005 | GGGTATATACTTTTTATTTTTGATAAATATATATTTTTATTTTTT<br>ATA*T*A*T*A*T*A*T*C*G*T*A*T*A*T*A*CCC |
| SEQ ID NO: 1006 | GGGTATATACTTTTTATTTTTGATAAATGTATATTTTTATTTTTT<br>ATA*C*A*T*A*T*A*T*C*G*T*A*T*A*T*A*CCC |
| SEQ ID NO: 1007 | GGGTATATACTTTTTATTTTTGATGATGTATATTTTTTATTTTTA<br>TAT*A*C*A*T*G*A*T*C*G*T*A*T*A*T*A*CCC |
| SEQ ID NO: 1008 | GGGTATATACTTTTTATTTTTGATGATATATGTTTTTATTTTTA<br>CAT*A*T*A*T*G*A*T*C*G*T*A*T*A*T*A*CCC |
| SEQ ID NO: 1009 | GTACATATATTTTTTATTTTTGATAAATATATTTTTATTTTTTA<br>TA*T*A*T*A*T*C*A*A*T*A*T*A*T*G*T*AC |
| SEQ ID NO: 1010 | GTACATATATTTTTTATTTTTGATAAATGTATTTTTATTTTTTA<br>CA*T*A*T*A*T*C*A*A*T*A*T*A*T*G*T*AC |
| SEQ ID NO: 1011 | GTACATATATTTTTTATTTTTGATGATGTATTTTTTATTTTTAT<br>AC*A*T*G*A*T*C*A*A*T*A*T*A*T*G*T*AC |

TABLE 1-continued

Nucleotide sequences of blocked nucleic acid molecules.

| SEQ ID NO: | Sequence |
|---|---|
| SEQ ID NO: 1012 | GTACATATATTTTTTATTTTTGATGATATATTTTTTATTTTTAT<br>AT*A*T*G*A*T*C*A*A*T*A*T*A*T*G*T*AC |
| SEQ ID NO: 1013 | GGTACATATATTTTTTATTTTTGATAAATATATTTTTTATTTTTA<br>TA*T*A*T*A*T*C*A*T*A*T*A*T*G*T*A*CC |
| SEQ ID NO: 1014 | GGTACATATATTTTTTATTTTTGATAAATGTATTTTTATTTTTA<br>CA*T*A*T*A*T*C*A*T*A*T*A*T*G*T*A*CC |
| SEQ ID NO: 1015 | GGTACATATATTTTTTATTTTTGATGATGTATTTTTTATTTTTAT<br>AC*A*T*G*A*T*C*A*T*A*T*A*T*G*T*A*CC |
| SEQ ID NO: 1016 | GGTACATATATTTTTTATTTTTGATGATATATTTTTTATTTTTAT<br>AT*A*T*G*A*T*C*A*T*A*T*A*T*G*T*A*CC |
| SEQ ID NO: 1017 | CGATCATATATTTTTTATTTTTGATAAATATATTTTTTATTTTT<br>ATA*T*A*T*A*T*C*A*A*T*A*T*A*T*G*A*TCG |
| SEQ ID NO: 1018 | CGATCATATATTTTTTATTTTTGATAAATGTATTTTTATTTTT<br>ACA*T*A*T*A*T*C*A*A*T*A*T*A*T*G*A*TCG |
| SEQ ID NO: 1019 | CGATCATATATTTTTTATTTTTGATGATGTATTTTTTATTTTTA<br>TAC*A*T*G*A*T*C*A*A*T*A*T*A*T*G*A*TCG |
| SEQ ID NO: 1020 | CGATCATATATTTTTTATTTTTGATGATATATTTTTTATTTTTA<br>TAT*A*T*G*A*T*C*A*A*T*A*T*A*T*G*A*TCG |
| SEQ ID NO: 1021 | GTATATACTTTTTATTTTTGATGATGTAAATATATTTTTATTTTT<br>TATA*T*A*T*A*C*A*T*G*A*T*C*G*T*A*T*ATAC |
| SEQ ID NO: 1022 | GTATATACTTTTTATTTTTGATGATATAAGTACTTTTTTATTTTT<br>AGTA*C*A*T*A*T*A*T*G*A*T*C*G*T*A*T*ATAC |
| SEQ ID NO: 1023 | GGATATACTTTTTATTTTTGATGATGTAAATATATTTTTATTTTT<br>TATA*T*A*T*A*C*A*T*G*A*T*C*G*T*A*T*ATCC |
| SEQ ID NO: 1024 | GGATATACTTTTTATTTTTGATGATATAAGTACTTTTTTATTTTT<br>AGTA*C*A*T*A*T*A*T*G*A*T*C*G*T*A*T*ATCC |
| SEQ ID NO: 1025 | GGTGATACTTTTTATTTTTGATGATGTAAATATATTTTTATTTTT<br>TATA*T*A*T*A*C*A*T*G*A*T*C*G*T*A*T*CACC |
| SEQ ID NO: 1026 | GGTGATACTTTTTATTTTTGATGATATAAGTACTTTTTTATTTTT<br>AGTA*C*A*T*A*T*A*T*G*A*T*C*G*T*A*T*CACC |
| SEQ ID NO: 1027 | GGTGATCCTTTTTATTTTTGATGATGTAAATATATTTTTATTTTT<br>TATA*T*A*T*A*C*A*T*G*A*T*C*G*G*A*T*CACC |
| SEQ ID NO: 1028 | GGTGATCCTTTTTATTTTTGATGATATAAGTACTTTTTTATTTTT<br>AGTA*C*A*T*A*T*A*T*G*A*T*C*G*G*A*T*CACC |
| SEQ ID NO: 1029 | GTATATACATTTTTATTTTTGATGATGTAAATATATTTTTATTT<br>TTTATA*T*A*T*A*C*A*T*G*A*T*C*A*T*G*T*ATATAC |
| SEQ ID NO: 1030 | GTATATACATTTTTATTTTTGATGATATAAGTACTTTTTTATTT<br>TTAGTA*C*A*T*A*T*A*T*G*A*T*C*A*T*G*T*ATATAC |
| SEQ ID NO: 1031 | GGATATACATTTTTATTTTTGATAAATGTAAATATTTTTTATT<br>TTTATAT*A*T*A*C*A*T*A*T*A*T*C*A*T*G*T*ATATCC |
| SEQ ID NO: 1032 | GGATATACATTTTTATTTTTGATGATGTAAATATATTTTTATT<br>TTTTATA*T*A*T*A*C*A*T*G*A*T*C*A*T*G*T*ATATCC |
| SEQ ID NO: 1033 | GGATATACATTTTTATTTTTGATGATATAAGTACTTTTTTATT<br>TTTAGTA*C*A*T*A*T*A*T*G*A*T*C*A*T*G*T*ATATCC |
| SEQ ID NO: 1034 | GGATATACACTTTTTATTTTTGATGATGTAAATATATTTTTATT<br>TTTTATA*T*A*T*A*C*A*T*G*A*T*C*G*T*G*T*ATATCC |
| SEQ ID NO: 1035 | GGATATACACTTTTTATTTTTGATGATATAAGTACTTTTTTATT<br>TTTAGTA*C*A*T*A*T*A*T*G*A*T*C*G*T*G*T*ATATCC |
| SEQ ID NO: 1036 | GGGTATATACTTTTTATTTTTGATGATGTAAATATATTTTTATT<br>TTTTATA*T*A*T*A*C*A*T*G*A*T*C*G*T*A*T*ATACCC |

TABLE 1-continued

Nucleotide sequences of blocked nucleic acid molecules.

| SEQ ID NO: | Sequence |
|---|---|
| SEQ ID NO: 1037 | GGGTATATACTTTTTATTTTTGATGATATAAGTACTTTTTTATT<br>TTTAGTA*C*A*T*A*T*A*T*G*A*T*C*G*T*A*T*ATACCC |
| SEQ ID NO: 1038 | GTATATACTTTTTATTTTTGATGATGTAAATATTTTTTATTTTA<br>TAT*A*T*A*C*A*T*G*A*T*C*G*T*A*T*A*TAC |
| SEQ ID NO: 1039 | GTATATACTTTTTATTTTTGATGATATAAGTACTTTTTATTTTG<br>TAC*A*T*A*T*A*T*G*A*T*C*G*T*A*T*A*TAC |
| SEQ ID NO: 1040 | GGATATACTTTTTATTTTTGATGATGTAAATATTTTTTATTTTA<br>TAT*A*T*A*C*A*T*G*A*T*C*G*T*A*T*A*TCC |
| SEQ ID NO: 1041 | GGATATACTTTTTATTTTTGATGATATAAGTACTTTTTATTTTT<br>GTAC*A*T*A*T*A*T*G*A*T*C*G*T*A*T*A*TCC |
| SEQ ID NO: 1042 | GGTGATACTTTTTATTTTTGATGATGTAAATATTTTTTATTTTA<br>TAT*A*T*A*C*A*T*G*A*T*C*G*T*A*T*C*ACC |
| SEQ ID NO: 1043 | GGTGATACTTTTTATTTTTGATGATATAAGTACTTTTTATTTTT<br>GTAC*A*T*A*T*A*T*G*A*T*C*G*T*A*T*C*ACC |
| SEQ ID NO: 1044 | GGTGATCCTTTTTATTTTTGATGATGTAAATATTTTTTATTTTA<br>TAT*A*T*A*C*A*T*G*A*T*C*G*G*A*T*C*ACC |
| SEQ ID NO: 1045 | GGTGATCCTTTTTATTTTTGATGATATAAGTACTTTTTATTTTTG<br>TAC*A*T*A*T*A*T*G*A*T*C*G*G*A*T*C*ACC |
| SEQ ID NO: 1046 | GTATATACATTTTTATTTTTGATGATGTAAATATTTTTTATTTT<br>TATAT*A*T*A*C*A*T*G*A*T*C*A*T*G*T*A*TATAC |
| SEQ ID NO: 1047 | GTATATACATTTTTATTTTTGATGATATAAGTACTTTTTATTTT<br>TGTAC*A*T*A*T*A*T*G*A*T*C*A*T*G*T*A*TATAC |
| SEQ ID NO: 1048 | GGATATACATTTTTATTTTTGATGATGTAAATATTTTTTATTTT<br>TATAT*A*T*A*C*A*T*G*A*T*C*A*T*G*T*A*TATCC |
| SEQ ID NO: 1049 | GGATATACATTTTTATTTTTGATGATATAAGTACTTTTTATTTT<br>TTGTAC*A*T*A*T*A*T*G*A*T*C*A*T*G*T*A*TATCC |
| SEQ ID NO: 1050 | GGATATACACTTTTTATTTTTGATGATGTAAATATTTTTTATTT<br>TTATAT*A*T*A*C*A*T*G*A*T*C*G*T*G*T*A*TATCC |
| SEQ ID NO: 1051 | GGATATACACTTTTTATTTTTGATGATATAAGTACTTTTTATTT<br>TTGTAC*A*T*A*T*A*T*G*A*T*C*G*T*G*T*A*TATCC |
| SEQ ID NO: 1052 | GGGTATATACTTTTTATTTTTGATGATGTAAATATTTTTTATTT<br>TATAT*A*T*A*C*A*T*G*A*T*C*G*T*A*T*A*TACCC |
| SEQ ID NO: 1053 | GGGTATATACTTTTTATTTTTGATGATATAAGTACTTTTTATTT<br>TTGTAC*A*T*A*T*A*T*G*A*T*C*G*T*A*T*A*TACCC |
| SEQ ID NO: 1054 | GTATATACATTTTTATTTTTGATGATATAAGTATTTTTATTTTT<br>TACA*T*A*T*A*T*G*A*T*C*A*T*G*T*A*T*ATAC |
| SEQ ID NO: 1055 | GGATATACATTTTTATTTTTGATAAATGAATATTTTTTATTTTT<br>ATAT*A*C*A*T*A*T*A*T*C*A*T*G*T*A*T*ATCC |
| SEQ ID NO: 1056 | GGATATACATTTTTATTTTTGATGATATAAGTATTTTTATTTTT<br>TACA*T*A*T*A*T*G*A*T*C*A*T*G*T*A*T*ATCC |
| SEQ ID NO: 1057 | GGATATACACTTTTTATTTTTGATAAATGAATATTTTTTATTTT<br>TATAT*A*C*A*T*A*T*A*T*C*G*T*G*T*A*T*ATCC |
| SEQ ID NO: 1058 | GGATATACACTTTTTATTTTTGATGATATAAGTATTTTTATTTT<br>TTACA*T*A*T*A*T*G*A*T*C*G*T*G*T*A*T*ATCC |
| SEQ ID NO: 1059 | GGGTATATACTTTTTATTTTTGATAAATGAATATTTTTTATTTT<br>TATAT*A*C*A*T*A*T*A*T*C*G*T*A*T*A*T*ACCC |
| SEQ ID NO: 1060 | GGGTATATACTTTTTATTTTTGATGATATAAGTATTTTTATTTT<br>TACA*T*A*T*A*T*G*A*T*C*G*T*A*T*A*T*ACCC |
| SEQ ID NO: 1061 | GTATATACATTTTTATTTTTGATGATGAATATTTTTTATTTTTA<br>TAT*A*C*A*T*G*A*T*C*A*T*G*T*A*T*A*TAC |

TABLE 1-continued

Nucleotide sequences of blocked nucleic acid molecules.

| SEQ ID NO: | Sequence |
| --- | --- |
| SEQ ID NO: 1062 | GGATATACATTTTTTATTTTTGATAAATGAATATTTTTATTTTT<br>ATA*C*A*T*A*T*A*T*C*A*T*G*T*A*T*A*TCC |
| SEQ ID NO: 1063 | GGATATACATTTTTTATTTTTGATGATGAATATTTTTATTTTTA<br>TAT*A*C*A*T*G*A*T*C*A*T*G*T*A*T*A*TCC |
| SEQ ID NO: 1064 | GGATATACATTTTTTATTTTTGATGATAAATGTTTTTATTTTTA<br>CAT*A*T*A*T*G*A*T*C*A*T*G*T*A*T*A*TCC |
| SEQ ID NO: 1065 | GGATATACACTTTTTATTTTTGATGATGAATATTTTTTATTTTT<br>ATAT*A*C*A*T*G*A*T*C*G*T*G*T*A*T*A*TCC |
| SEQ ID NO: 1066 | GGGTATATACTTTTTATTTTTGATGATGAATATTTTTATTTTTA<br>TAT*A*C*A*T*G*A*T*C*G*T*A*T*A*T*A*CCC |
| SEQ ID NO: 1067 | GATACTTTTTATTTTTGATGATGTAAATATATTTTTATTTTTAT<br>A*T*A*T*A*C*A*T*G*A*T*C*G*T*A*T*C |
| SEQ ID NO: 1068 | GATACTTTTTATTTTTGATGATATAAGTACTTTTTATTTTTAGT<br>A*C*A*T*A*T*A*T*G*A*T*C*G*T*A*T*C |
| SEQ ID NO: 1069 | GACACTTTTTATTTTTGATGATGTAAATATATTTTTATTTTTAT<br>A*T*A*T*A*C*A*T*G*A*T*C*G*T*G*T*C |
| SEQ ID NO: 1070 | GACACTTTTTATTTTTGATGATATAAGTACTTTTTATTTTTAGT<br>A*C*A*T*A*T*A*T*G*A*T*C*G*T*G*T*C |
| SEQ ID NO: 1071 | GGATCTTTTTATTTTTGATGATGTAAATATATTTTTATTTTTAT<br>A*T*A*T*A*C*A*T*G*A*T*C*G*A*T*C*C |
| SEQ ID NO: 1072 | GGATCTTTTTATTTTTGATGATATAAGTACTTTTTATTTTTAGT<br>A*C*A*T*A*T*A*T*G*A*T*C*G*A*T*C*C |
| SEQ ID NO: 1073 | GCGTCTTTTTATTTTTGATGATGTAAATATATTTTTATTTTTAT<br>A*T*A*T*A*C*A*T*G*A*T*C*G*A*C*G*C |
| SEQ ID NO: 1074 | GCGTCTTTTTATTTTTGATGATATAAGTACTTTTTATTTTTAGT<br>A*C*A*T*A*T*A*T*G*A*T*C*G*A*C*G*C |
| SEQ ID NO: 1075 | GTATACTTTTTATTTTTGATGATGTAAATATTTTTATTTTTATA<br>T*A*T*A*C*A*T*G*A*T*C*G*T*A*T*A*C |
| SEQ ID NO: 1076 | GTATACTTTTTATTTTTGATGATATAAGTACTTTTTATTTTTGTA<br>C*A*T*A*T*A*T*G*A*T*C*G*T*A*T*A*C |
| SEQ ID NO: 1077 | GTGATCTTTTTATTTTTGATGATGTAAATATTTTTATTTTTATA<br>T*A*T*A*C*A*T*G*A*T*C*G*A*T*C*A*C |
| SEQ ID NO: 1078 | GTGATCTTTTTATTTTTGATGATATAAGTACTTTTTATTTTTGTA<br>C*A*T*A*T*A*T*G*A*T*C*G*A*T*C*A*C |
| SEQ ID NO: 1079 | GGATACTTTTTATTTTTGATGATGTAAATATTTTTATTTTTATA<br>T*A*T*A*C*A*T*G*A*T*C*G*T*A*T*C*C |
| SEQ ID NO: 1080 | GGATACTTTTTATTTTTGATGATATAAGTACTTTTTATTTTTGT<br>AC*A*T*A*T*A*T*G*A*T*C*G*T*A*T*C*C |
| SEQ ID NO: 1081 | GCGATCTTTTTATTTTTGATGATGTAAATATTTTTATTTTTATA<br>T*A*T*A*C*A*T*G*A*T*C*G*A*T*C*G*C |
| SEQ ID NO: 1082 | GCGATCTTTTTATTTTTGATGATATAAGTACTTTTTATTTTTGTA<br>C*A*T*A*T*A*T*G*A*T*C*G*A*T*C*G*C |
| SEQ ID NO: 1083 | GATATATTTTTATTTTTGATGATATAAGTATTTTTATTTTTTAC<br>A*T*A*T*A*T*G*A*T*C*A*T*A*T*A*T*C |
| SEQ ID NO: 1084 | GATATACTTTTTATTTTTGATGATATAAGTATTTTTATTTTTTAC<br>A*T*A*T*A*T*G*A*T*C*G*T*A*T*A*T*C |
| SEQ ID NO: 1085 | GTGATACTTTTTATTTTTGATAAATGAATATTTTTATTTTTATA<br>T*A*C*A*T*A*T*A*T*C*G*T*A*T*C*A*C |
| SEQ ID NO: 1086 | GTGATACTTTTTATTTTTGATGATATAAGTATTTTTATTTTTTAC<br>A*T*A*T*A*T*G*A*T*C*G*T*A*T*C*A*C |

TABLE 1-continued

Nucleotide sequences of blocked nucleic acid molecules.

| SEQ ID NO: | Sequence |
|---|---|
| SEQ ID NO: 1087 | GGTATACTTTTTATTTTTGATAAATGAATATTTTTATTTTTATA<br>T*A*C*A*T*A*T*A*T*C*G*T*A*T*A*C*C |
| SEQ ID NO: 1088 | GGTATACTTTTTATTTTTGATGATATAAGTATTTTTATTTTTAC<br>A*T*A*T*A*T*G*A*T*C*G*T*A*T*A*C*C |
| SEQ ID NO: 1089 | GGTGTACTTTTTATTTTTGATAAATGAATATTTTTATTTTTATA<br>T*A*C*A*T*A*T*A*T*C*G*T*A*C*A*C*C |
| SEQ ID NO: 1090 | GGTGTACTTTTTATTTTTGATGATATAAGTATTTTTATTTTTAC<br>A*T*A*T*A*T*G*A*T*C*G*T*A*C*A*C*C |
| SEQ ID NO: 1091 | GTATATACTTTTTATTTTTGATGATGAATATTTTTATTTTTATA<br>T*A*C*A*T*G*A*T*C*G*T*A*T*A*T*A*C |
| SEQ ID NO: 1092 | GTATATACTTTTTATTTTTGATGATAAATGTTTTTATTTTTACA<br>T*A*T*A*T*G*A*T*C*G*T*A*T*A*T*A*C |
| SEQ ID NO: 1093 | GGATATACTTTTTATTTTTGATGATGAATATTTTTATTTTTATA<br>T*A*C*A*T*G*A*T*C*G*T*A*T*A*T*C*C |
| SEQ ID NO: 1094 | GGTGATACTTTTTATTTTTGATGATGAATATTTTTATTTTTATA<br>T*A*C*A*T*G*A*T*C*G*T*A*T*A*T*C*A*C*C |
| SEQ ID NO: 1095 | GGTGATACTTTTTATTTTTGATGATAAATGTTTTTATTTTTAC<br>AT*A*T*A*T*G*A*T*C*G*T*A*T*C*A*C*C |
| SEQ ID NO: 1096 | GGTGATCCTTTTTATTTTTGATGATGAATATTTTTATTTTTATA<br>T*A*C*A*T*G*A*T*C*G*G*A*T*C*A*C*C |
| SEQ ID NO: 1097 | GATACTTTTTATTTTTGATATAAATATATAATTTTTATTTTTATA<br>T*A*T*A*T*A*T*A*T*A*T*C*G*T*A*T*C |
| SEQ ID NO: 1098 | GATACTTTTTATTTTTGATAAATGAATATATTTTTATTTTTATA<br>T*A*T*A*C*A*T*A*T*A*T*C*G*T*A*T*C |
| SEQ ID NO: 1099 | GACACTTTTTATTTTTGATATAAATATATAATTTTTATTTTTAT<br>AT*A*T*A*T*A*T*A*T*C*G*T*G*T*C |
| SEQ ID NO: 1100 | GACACTTTTTATTTTTGATAAATGAATATATTTTTATTTTTAT<br>AT*A*T*A*C*A*T*A*T*A*T*C*G*T*G*T*C |
| SEQ ID NO: 1101 | GACACTTTTTATTTTTGATATAAGTAAATATTTTTATTTTTAT<br>AT*A*T*A*C*A*T*A*T*A*T*C*G*T*G*T*C |
| SEQ ID NO: 1102 | GGATCTTTTTATTTTTGATATAAATATATAATTTTTATTTTTATA<br>T*A*T*A*T*A*T*A*T*A*T*C*G*A*T*C*C |
| SEQ ID NO: 1103 | GGATCTTTTTATTTTTGATAAATGAATATATTTTTATTTTTATA<br>T*A*T*A*C*A*T*A*T*A*T*C*G*A*T*C*C |
| SEQ ID NO: 1104 | GGATCTTTTTATTTTTGATATAAGTAAATATTTTTATTTTTATA<br>T*A*T*A*C*A*T*A*T*A*T*C*G*A*T*C*C |
| SEQ ID NO: 1105 | GCGTCTTTTTATTTTTGATATAAATATATAATTTTTATTTTTATA<br>T*A*T*A*T*A*T*A*T*A*T*C*G*A*C*G*C |
| SEQ ID NO: 1106 | GCGTCTTTTTATTTTTGATAAATGAATATATTTTTATTTTTATA<br>T*A*T*A*C*A*T*A*T*A*T*C*G*A*C*G*C |
| SEQ ID NO: 1107 | GCGTCTTTTTATTTTTGATATAAGTAAATATTTTTATTTTTATA<br>T*A*T*A*C*A*T*A*T*A*T*C*G*A*C*G*C |
| SEQ ID NO: 1108 | GTATATACATTTTTATTTTTGATATAAATATATAATTTTTATTT<br>TTATAT*A*T*A*T*A*T*A*T*A*T*C*A*T*G*T*ATATAC |
| SEQ ID NO: 1109 | GTATATACATTTTTATTTTTGATAAATGAATATATTTTTATTT<br>TTATAT*A*T*A*C*A*T*A*T*A*T*C*A*T*G*T*ATATAC |
| SEQ ID NO: 1110 | GTATATACATTTTTATTTTTGATATAAGTAAATATTTTTATTT<br>TTATAT*A*T*A*C*A*T*A*T*A*T*C*A*T*G*T*ATATAC |
| SEQ ID NO: 1111 | GGATATACATTTTTATTTTTGATATAAATATATAATTTTTATT<br>TTTATAT*A*T*A*T*A*T*A*T*A*T*C*A*T*G*T*ATATCC |

TABLE 1-continued

Nucleotide sequences of blocked nucleic acid molecules.

| SEQ ID NO: | Sequence |
|---|---|
| SEQ ID NO: 1112 | GGATATACACTTTTTATTTTTGATATAAATATATAATTTTTATT<br>TTTATAT\*A\*T\*A\*T\*A\*T\*A\*T\*A\*T\*C\*G\*T\*G\*T\*ATATCC |
| SEQ ID NO: 1113 | GGATATACACTTTTTATTTTTGATAAATGAATATATTTTTATT<br>TTTATAT\*A\*T\*A\*C\*A\*T\*A\*T\*A\*T\*C\*G\*T\*G\*T\*ATATCC |
| SEQ ID NO: 1114 | GGATATACACTTTTTATTTTTGATATAAGTAAATATTTTTATT<br>TTTATAT\*A\*T\*A\*C\*A\*T\*A\*T\*A\*T\*C\*G\*T\*G\*T\*ATATCC |
| SEQ ID NO: 1115 | GGGTATATACTTTTTATTTTTGATATAAATATATAATTTTTATT<br>TTTATAT\*A\*T\*A\*T\*A\*T\*A\*T\*A\*T\*C\*G\*T\*A\*T\*ATACCC |
| SEQ ID NO: 1116 | GGGTATATACTTTTTATTTTTGATAAATGAATATATTTTTATT<br>TTTATAT\*A\*T\*A\*C\*A\*T\*A\*T\*A\*T\*C\*G\*T\*A\*T\*ATACCC |
| SEQ ID NO: 1117 | GGGTATATACTTTTTATTTTTGATATAAGTAAATATTTTTATT<br>TTTATAT\*A\*T\*A\*C\*A\*T\*A\*T\*A\*T\*C\*G\*T\*A\*T\*ATACCC |
| SEQ ID NO: 1118 | GTATACTTTTTATTTTTTATAAATATATATTTTTTATTTTTAT<br>A\*T\*A\*T\*A\*T\*A\*T\*A\*T\*A\*G\*T\*A\*T\*A\*C |
| SEQ ID NO: 1119 | GTGATCTTTTTATTTTTTATAAATATATATTTTTTATTTTTTAT<br>A\*T\*A\*T\*A\*T\*A\*T\*A\*T\*A\*G\*A\*T\*C\*A\*C |
| SEQ ID NO: 1120 | GTATACTTTTTATTTTTGATATAAATATATTTTTTATTTTTTAT<br>A\*T\*A\*T\*A\*T\*A\*T\*A\*T\*C\*G\*T\*A\*T\*A\*C |
| SEQ ID NO: 1121 | GTATACTTTTTATTTTTGATATATAAATATTTTTTATTTTTTAT<br>A\*T\*A\*T\*A\*T\*A\*T\*A\*T\*C\*G\*T\*A\*T\*A\*C |
| SEQ ID NO: 1122 | GTATACTTTTTATTTTTGATAAATGAATATATTTTTTATTTTTTAT<br>A\*T\*A\*C\*A\*T\*A\*T\*A\*T\*C\*G\*T\*A\*T\*A\*C |
| SEQ ID NO: 1123 | GGATACTTTTTATTTTTTATAAATATATATTTTTTATTTTTTAT<br>A\*T\*A\*T\*A\*T\*A\*T\*A\*T\*A\*G\*T\*A\*T\*C\*C |
| SEQ ID NO: 1124 | GTGATCTTTTTATTTTTGATATAAATATATTTTTTATTTTTTAT<br>A\*T\*A\*T\*A\*T\*A\*T\*A\*T\*C\*G\*A\*T\*C\*A\*C |
| SEQ ID NO: 1125 | GTGATCTTTTTATTTTTGATATATAAATATTTTTTATTTTTTAT<br>A\*T\*A\*T\*A\*T\*A\*T\*A\*T\*C\*G\*A\*T\*C\*A\*C |
| SEQ ID NO: 1126 | GTGATCTTTTTATTTTTGATAAATGAATATATTTTTTATTTTTTAT<br>A\*T\*A\*C\*A\*T\*A\*T\*A\*T\*C\*G\*A\*T\*C\*A\*C |
| SEQ ID NO: 1127 | GGATACTTTTTATTTTTGATATAAATATATTTTTTATTTTTTAT<br>A\*T\*A\*T\*A\*T\*A\*T\*A\*T\*C\*G\*T\*A\*T\*C\*C |
| SEQ ID NO: 1128 | GGATACTTTTTATTTTTGATATATAAATATTTTTTATTTTTTAT<br>A\*T\*A\*T\*A\*T\*A\*T\*A\*T\*C\*G\*T\*A\*T\*C\*C |
| SEQ ID NO: 1129 | GGATACTTTTTATTTTTGATAAATGAATATATTTTTTATTTTTTAT<br>A\*T\*A\*C\*A\*T\*A\*T\*A\*T\*C\*G\*T\*A\*T\*C\*C |
| SEQ ID NO: 1130 | GCGATCTTTTTATTTTTTATAAATATATATTTTTTATTTTTTAT<br>A\*T\*A\*T\*A\*T\*A\*T\*A\*T\*A\*G\*A\*T\*C\*G\*C |
| SEQ ID NO: 1131 | GCGATCTTTTTATTTTTGATATAAATATATTTTTTATTTTTTAT<br>A\*T\*A\*T\*A\*T\*A\*T\*A\*T\*C\*G\*A\*T\*C\*G\*C |
| SEQ ID NO: 1132 | GCGATCTTTTTATTTTTGATATATAAATATTTTTTATTTTTTAT<br>A\*T\*A\*T\*A\*T\*A\*T\*A\*T\*C\*G\*A\*T\*C\*G\*C |
| SEQ ID NO: 1133 | GCGATCTTTTTATTTTTGATAAATGAATATATTTTTTATTTTTTAT<br>A\*T\*A\*C\*A\*T\*A\*T\*A\*T\*C\*G\*A\*T\*C\*G\*C |
| SEQ ID NO: 1134 | GATATATCACTTTTTATTTTTTATAAATATATATTTTTTATTT<br>TTATA\*T\*A\*T\*A\*T\*A\*T\*A\*T\*A\*G\*T\*G\*A\*T\*ATATC |
| SEQ ID NO: 1135 | GTATATACATTTTTTATTTTTGATATAAATATATTTTTTATTT<br>TTATA\*T\*A\*T\*A\*T\*A\*T\*A\*T\*C\*A\*T\*G\*T\*A\*TATAC |
| SEQ ID NO: 1136 | GTATATACATTTTTTATTTTTGATATATAAATATTTTTTATTT<br>TTATA\*T\*A\*T\*A\*T\*A\*T\*A\*T\*C\*A\*T\*G\*T\*A\*TATAC |

TABLE 1-continued

Nucleotide sequences of blocked nucleic acid molecules.

| SEQ ID NO: | Sequence |
|---|---|
| SEQ ID NO: 1137 | GGATATACACTTTTTATTTTTTATAAATATATATTTTTTTATTTT<br>TTATA*T*A*T*A*T*A*T*A*G*T*G*T*A*TATCC |
| SEQ ID NO: 1138 | GGATATACATTTTTTATTTTTGATATAAATATATTTTTTTATTTT<br>TTATA*T*A*T*A*T*A*T*A*T*C*A*T*G*T*A*TATCC |
| SEQ ID NO: 1139 | GGATATACATTTTTTATTTTTGATATATAAATATTTTTTTATTTT<br>TTATA*T*A*T*A*T*A*T*A*T*C*A*T*G*T*A*TATCC |
| SEQ ID NO: 1140 | GGATATACATTTTTTATTTTTGATAAATGAATATATTTTTATTT<br>TTTATA*T*A*C*A*T*A*T*A*T*C*A*T*G*T*A*TATCC |
| SEQ ID NO: 1141 | GGGTATATACTTTTTTATTTTTTATAAATATATATTTTTTTATTTT<br>TTATA*T*A*T*A*T*A*T*A*T*A*G*T*A*T*A*TACCC |
| SEQ ID NO: 1142 | GGATATACACTTTTTATTTTTGATATAAATATATTTTTTTATTTT<br>TTATA*T*A*T*A*T*A*T*A*T*C*G*T*G*T*A*TATCC |
| SEQ ID NO: 1143 | GGATATACACTTTTTATTTTTGATATATAAATATTTTTTTATTTT<br>TTATA*T*A*T*A*T*A*T*A*T*C*G*T*G*T*A*TATCC |
| SEQ ID NO: 1144 | GGATATACACTTTTTATTTTTGATAAATGAATATATTTTTATTT<br>TTTATA*T*A*C*A*T*A*T*A*T*C*G*T*G*T*A*TATCC |
| SEQ ID NO: 1145 | GGGTATATACTTTTTTATTTTTGATATAAATATATTTTTTTATTTT<br>TTATA*T*A*T*A*T*A*T*A*T*C*G*T*A*T*A*TACCC |
| SEQ ID NO: 1146 | GGGTATATACTTTTTTATTTTTGATATATAAATATTTTTTTATTTT<br>TTATA*T*A*T*A*T*A*T*A*T*C*G*T*A*T*A*TACCC |
| SEQ ID NO: 1147 | GGGTATATACTTTTTTATTTTTGATAAATGAATATATTTTTATTT<br>TTTATA*T*A*C*A*T*A*T*A*T*C*G*T*A*T*A*TACCC |
| SEQ ID NO: 1148 | GATATACTTTTTATTTTTGATAAATATATAATTTTTATTTTTATA<br>T*A*T*A*T*A*T*A*T*C*G*T*A*T*A*T*C |
| SEQ ID NO: 1149 | GTGATACTTTTTATTTTTGATAAATATATAATTTTTATTTTTATA<br>T*A*T*A*T*A*T*A*T*C*G*T*A*T*C*A*C |
| SEQ ID NO: 1150 | GGTATACTTTTTATTTTTGATAAATATATAATTTTTATTTTTATA<br>T*A*T*A*T*A*T*A*T*C*G*T*A*T*A*C*C |
| SEQ ID NO: 1151 | GGTGTACTTTTTATTTTTGATAAATATATAATTTTTATTTTTATA<br>T*A*T*A*T*A*T*A*T*C*G*T*A*C*A*C*C |
| SEQ ID NO: 1152 | GTATATACATTTTTTATTTTTGATAAATATATAATTTTTATTTTT<br>ATAT*A*T*A*T*A*T*A*T*C*A*T*G*T*A*T*ATAC |
| SEQ ID NO: 1153 | GGATATACATTTTTTATTTTTGATAAATATATAATTTTTATTTTT<br>ATAT*A*T*A*T*A*T*A*T*C*A*T*G*T*A*T*ATCC |
| SEQ ID NO: 1154 | GGATATACACTTTTTATTTTTGATAAATATATAATTTTTATTTT<br>TATAT*A*T*A*T*A*T*A*T*C*G*T*G*T*A*T*ATCC |
| SEQ ID NO: 1155 | GGGTATATACTTTTTATTTTTGATAAATATATAATTTTTATTTTT<br>ATAT*A*T*A*T*A*T*A*T*C*G*T*A*T*A*T*ACCC |
| SEQ ID NO: 1156 | GTATATACTTTTTATTTTTGATAAATATATTTTTTATTTTTTAT<br>A*T*A*T*A*T*A*T*C*G*T*A*T*A*T*A*C |
| SEQ ID NO: 1157 | GTATATACTTTTTATTTTTGATAAATGTATTTTTTATTTTTTAT<br>A*C*A*T*A*T*A*T*C*G*T*A*T*A*T*A*C |
| SEQ ID NO: 1158 | GGATATACTTTTTATTTTTGATAAATATATTTTTTATTTTTTAT<br>A*T*A*T*A*T*A*T*C*G*T*A*T*A*T*C*C |
| SEQ ID NO: 1159 | GGATATACTTTTTATTTTTGATAAATGTATTTTTTATTTTTTAT<br>A*C*A*T*A*T*A*T*C*G*T*A*T*A*T*C*C |
| SEQ ID NO: 1160 | GGATATACTTTTTATTTTTGATGATAAATGTTTTTATTTTTAC<br>AT*A*T*A*T*G*A*T*C*G*T*A*T*A*T*C*C |
| SEQ ID NO: 1161 | GGTGATACTTTTTATTTTTGATAAATATATTTTTTATTTTTTAT<br>A*T*A*T*A*T*A*T*C*G*T*A*T*C*A*C*C |

TABLE 1-continued

Nucleotide sequences of blocked nucleic acid molecules.

| SEQ ID NO: | Sequence |
|---|---|
| SEQ ID NO: 1162 | GGTGATACTTTTTATTTTTGATAAATGTATTTTTTATTTTTAT<br>A*C*A*T*A*T*A*T*C*G*T*A*T*C*A*C*C |
| SEQ ID NO: 1163 | GGTGATCCTTTTTATTTTTGATAAATATATTTTTTATTTTTAT<br>A*T*A*T*A*T*A*T*C*G*G*A*T*C*A*C*C |
| SEQ ID NO: 1164 | GGTGATCCTTTTTATTTTTGATAAATGTATTTTTTATTTTTAT<br>A*C*A*T*A*T*A*T*C*G*G*A*T*C*A*C*C |
| SEQ ID NO: 1165 | GGTGATCCTTTTTATTTTTGATGATAAATGTTTTTTATTTTTACA<br>T*A*T*A*T*G*A*T*C*G*G*A*T*C*A*C*C |
| SEQ ID NO: 1166 | GTATATACATTTTTTATTTTTGATAAATATATTTTTTATTTTTT<br>ATA*T*A*T*A*T*A*T*C*A*T*G*T*A*T*A*TAC |
| SEQ ID NO: 1167 | GTATATACATTTTTTATTTTTGATAAATGTATTTTTTATTTTTT<br>ATA*C*A*T*A*T*A*T*C*A*T*G*T*A*T*A*TAC |
| SEQ ID NO: 1168 | GTATATACATTTTTTATTTTTGATGATAAATGTTTTTTATTTTTA<br>CAT*A*T*A*T*G*A*T*C*A*T*G*T*A*T*A*TAC |
| SEQ ID NO: 1169 | GGATATACATTTTTTATTTTTGATAAATATATTTTTTATTTTTT<br>ATA*T*A*T*A*T*A*T*C*A*T*G*T*A*T*A*TCC |
| SEQ ID NO: 1170 | GGATATACACTTTTTATTTTTGATAAATATATTTTTTATTTTTT<br>ATA*T*A*T*A*T*A*T*C*G*T*G*T*A*T*A*TCC |
| SEQ ID NO: 1171 | GGATATACACTTTTTATTTTTGATAAATGTATTTTTTATTTTTT<br>ATA*C*A*T*A*T*A*T*C*G*T*G*T*A*T*A*TCC |
| SEQ ID NO: 1172 | GGATATACACTTTTTATTTTTGATGATAAATGTTTTTTATTTTT<br>ACAT*A*T*A*T*G*A*T*C*G*T*G*T*A*T*A*TCC |
| SEQ ID NO: 1173 | GGGTATATACTTTTTATTTTTGATAAATATATTTTTTATTTTTT<br>ATA*T*A*T*A*T*A*T*C*G*T*A*T*A*T*A*CCC |
| SEQ ID NO: 1174 | GGGTATATACTTTTTATTTTTGATAAATGTATTTTTTATTTTTT<br>ATA*C*A*T*A*T*A*T*C*G*T*A*T*A*T*A*CCC |
| SEQ ID NO: 1175 | GGGTATATACTTTTTATTTTTGATGATAAATGTTTTTTATTTTTA<br>CAT*A*T*A*T*G*A*T*C*G*T*A*T*A*T*A*CCC |
| SEQ ID NO: 1176 | GTATATACATTTTTTATTTTTGATAAATATATTTTTTATTTTTAT<br>A*T*A*T*A*T*C*A*T*G*T*A*T*A*T*A*C |
| SEQ ID NO: 1177 | GTATATACATTTTTTATTTTTGATAAATGTTTTTTATTTTTTAC<br>A*T*A*T*A*T*C*A*T*G*T*A*T*A*T*A*C |
| SEQ ID NO: 1178 | GGATATACATTTTTTATTTTTGATAAATATTTTTTATTTTTTAT<br>A*T*A*T*A*T*C*A*T*G*T*A*T*A*T*C*C |
| SEQ ID NO: 1179 | GGATATACATTTTTTATTTTTGATAAATGTTTTTTATTTTTTAC<br>A*T*A*T*A*T*C*A*T*G*T*A*T*A*T*C*C |
| SEQ ID NO: 1180 | GGATATACATTTTTTATTTTTGATGATGAATTTTTTATTTTTATA<br>C*A*T*G*A*T*C*A*T*G*T*A*T*A*T*C*C |
| SEQ ID NO: 1181 | GGATATACACTTTTTATTTTTGATAAATATTTTTTATTTTTTAT<br>A*T*A*T*A*T*C*G*T*G*T*A*T*A*T*C*C |
| SEQ ID NO: 1182 | GGATATACACTTTTTATTTTTGATAAATGTTTTTTATTTTTTAC<br>A*T*A*T*A*T*C*G*T*G*T*A*T*A*T*C*C |
| SEQ ID NO: 1183 | GGGTATATACTTTTTATTTTTGATAAATATTTTTTATTTTTTAT<br>A*T*A*T*A*T*C*G*T*A*T*A*T*A*C*C*C |
| SEQ ID NO: 1184 | GGGTATATACTTTTTATTTTTGATAAATGTTTTTTATTTTTTAC<br>A*T*A*T*A*T*C*G*T*A*T*A*T*A*C*C*C |
| SEQ ID NO: 1185 | GGATGTACACTTTTTATTTTTGATAAATATTTTTTATTTTTTAT<br>A*T*A*T*A*T*C*G*T*G*T*A*C*A*T*C*C |
| SEQ ID NO: 1186 | GGATGTACACTTTTTATTTTTGATAAATGTTTTTTATTTTTTAC<br>A*T*A*T*A*T*C*G*T*G*T*A*C*A*T*C*C |

TABLE 1-continued

Nucleotide sequences of blocked nucleic acid molecules.

| SEQ ID NO: | Sequence |
| --- | --- |
| SEQ ID NO: 1187 | GTACATATATTTTTTATTTTTGATAAATATTTTTTATTTTTA<br>TA*T*A*T*A*T*C*A*A*T*A*T*A*T*G*T*AC |
| SEQ ID NO: 1188 | GTACATATATTTTTTATTTTTGATAAATGTTTTTTATTTTTA<br>CA*T*A*T*A*T*C*A*A*T*A*T*A*T*G*T*AC |
| SEQ ID NO: 1189 | GGTACATATATTTTTTATTTTTGATAAATATTTTTTATTTTTA<br>TA*T*A*T*A*T*C*A*T*A*T*A*T*G*T*A*CC |
| SEQ ID NO: 1190 | GGTACATATATTTTTTATTTTTGATAAATGTTTTTTATTTTTA<br>CA*T*A*T*A*T*C*A*T*A*T*A*T*G*T*A*CC |
| SEQ ID NO: 1191 | CGATCATATATTTTTTATTTTTGATAAATATTTTTTATTTTT<br>ATA*T*A*T*A*T*C*A*A*T*A*T*A*T*G*A*TCG |
| SEQ ID NO: 1192 | CGATCATATATTTTTTATTTTTGATAAATGTTTTTTATTTTT<br>ACA*T*A*T*A*T*C*A*A*T*A*T*A*T*G*A*TCG |
| SEQ ID NO: 1193 | CGATCATATATTTTTTATTTTTGATGATGAATTTTTTATTTTA<br>TAC*A*T*G*A*T*C*A*A*T*A*T*A*T*G*A*TCG |
| SEQ ID NO: 1194 | CGATCATATATTTTTTATTTTTGATGATAAATTTTTTATTTTA<br>TAT*A*T*G*A*T*C*A*A*T*A*T*A*T*G*A*TCG |
| SEQ ID NO: 1195 | GTATATACTTTTTATTTTTGATATAAATATATAATTTTTATTTTT<br>ATAT*A*T*A*T*A*T*A*T*A*T*C*G*T*A*T*ATAC |
| SEQ ID NO: 1196 | GTATATACTTTTTATTTTTGATAAATGAATATATTTTTTATTTTT<br>ATAT*A*T*A*C*A*T*A*T*A*T*C*G*T*A*T*ATAC |
| SEQ ID NO: 1197 | GGATATACTTTTTATTTTTGATATAAATATATAATTTTTATTTTT<br>ATAT*A*T*A*T*A*T*A*T*A*T*C*G*T*A*T*ATCC |
| SEQ ID NO: 1198 | GGATATACTTTTTATTTTTGATAAATGAATATATTTTTTATTTTT<br>ATAT*A*T*A*C*A*T*A*T*A*T*C*G*T*A*T*ATCC |
| SEQ ID NO: 1199 | GGTGATACTTTTTATTTTTGATATAAATATATAATTTTTATTTTT<br>ATAT*A*T*A*T*A*T*A*T*A*T*C*G*T*A*T*CACC |
| SEQ ID NO: 1200 | GGTGATACTTTTTATTTTTGATAAATGAATATATTTTTTATTTTT<br>ATAT*A*T*A*C*A*T*A*T*A*T*C*G*T*A*T*CACC |
| SEQ ID NO: 1201 | GGTGATCCTTTTTATTTTTGATATAAATATATAATTTTTATTTTT<br>ATAT*A*T*A*T*A*T*A*T*A*T*C*G*G*A*T*CACC |
| SEQ ID NO: 1202 | GGTGATCCTTTTTATTTTTGATAAATGAATATATTTTTTATTTTT<br>ATAT*A*T*A*C*A*T*A*T*A*T*C*G*G*A*T*CACC |
| SEQ ID NO: 1203 | GTATATACTTTTTATTTTTGATATAAGTAAATATTTTTTATTTTT<br>ATAT*A*T*A*C*A*T*A*T*A*T*C*G*T*A*T*ATAC |
| SEQ ID NO: 1204 | GGATATACTTTTTATTTTTGATATAAGTAAATATTTTTTATTTTT<br>ATAT*A*T*A*C*A*T*A*T*A*T*C*G*T*A*T*ATCC |
| SEQ ID NO: 1205 | GGTGATACTTTTTATTTTTGATATAAGTAAATATTTTTTATTTTT<br>ATAT*A*T*A*C*A*T*A*T*A*T*C*G*T*A*T*CACC |
| SEQ ID NO: 1206 | GGTGATCCTTTTTATTTTTGATATAAGTAAATATTTTTTATTTTT<br>ATAT*A*T*A*C*A*T*A*T*A*T*C*G*G*A*T*CACC |
| SEQ ID NO: 1207 | GTATATACTTTTTATTTTTTATAAATATATATTTTTTATTTTTT<br>ATA*T*A*T*A*T*A*T*A*T*A*G*T*A*T*A*TAC |
| SEQ ID NO: 1208 | GTATATACTTTTTATTTTTGATATAAATATATTTTTTTATTTTTT<br>ATA*T*A*T*A*T*A*T*A*T*C*G*T*A*T*A*TAC |
| SEQ ID NO: 1209 | GTATATACTTTTTATTTTTGATAAATGAATATATTTTTTATTTTTT<br>ATA*T*A*C*A*T*A*T*A*T*C*G*T*A*T*A*TAC |
| SEQ ID NO: 1210 | GGATATACTTTTTATTTTTTATAAATATATATTTTTTATTTTTT<br>ATA*T*A*T*A*T*A*T*A*T*A*G*T*A*T*A*TCC |
| SEQ ID NO: 1211 | GGATATACTTTTTATTTTTGATATAAATATATTTTTTTATTTTTT<br>ATA*T*A*T*A*T*A*T*A*T*C*G*T*A*T*A*TCC |

TABLE 1-continued

Nucleotide sequences of blocked nucleic acid molecules.

| SEQ ID NO: | Sequence |
|---|---|
| SEQ ID NO: 1212 | GGATATACTTTTTATTTTTGATAAATGAATATATTTTTATTTTTT<br>ATA*T*A*C*A*T*A*T*A*T*C*G*T*A*T*A*TCC |
| SEQ ID NO: 1213 | GGTGATACTTTTTATTTTTTATAAATATATATTTTTTATTTTTT<br>ATA*T*A*T*A*T*A*T*A*T*A*G*T*A*T*C*ACC |
| SEQ ID NO: 1214 | GGTGATACTTTTTATTTTTGATATAAATATATTTTTTATTTTTT<br>ATA*T*A*T*A*T*A*T*A*T*C*G*T*A*T*C*ACC |
| SEQ ID NO: 1215 | GGTGATACTTTTTATTTTTGATAAATGAATATATTTTTATTTTTT<br>ATA*T*A*C*A*T*A*T*A*T*C*G*T*A*T*C*ACC |
| SEQ ID NO: 1216 | GGTGATCCTTTTTATTTTTTATAAATATATATTTTTTATTTTTT<br>ATA*T*A*T*A*T*A*T*A*T*A*G*G*A*T*C*ACC |
| SEQ ID NO: 1217 | GGTGATCCTTTTTATTTTTGATATAAATATATTTTTTATTTTTT<br>ATA*T*A*T*A*T*A*T*A*T*C*G*G*A*T*C*ACC |
| SEQ ID NO: 1218 | GGTGATCCTTTTTATTTTTGATAAATGAATATATTTTTATTTTTT<br>ATA*T*A*C*A*T*A*T*A*T*C*G*G*A*T*C*ACC |
| SEQ ID NO: 1219 | GTATATACTTTTTATTTTTGATATAAATATTTTTTATTTTTT<br>ATA*T*A*T*A*T*A*T*A*T*C*G*T*A*T*A*TAC |
| SEQ ID NO: 1220 | GGATATACTTTTTATTTTTGATATAAATATTTTTTATTTTTT<br>ATA*T*A*T*A*T*A*T*A*T*C*G*T*A*T*A*TCC |
| SEQ ID NO: 1221 | GGTGATACTTTTTATTTTTGATATAAATATTTTTTATTTTTT<br>ATA*T*A*T*A*T*A*T*A*T*C*G*T*A*T*C*ACC |
| SEQ ID NO: 1222 | GGTGATCCTTTTTATTTTTGATATAAATATTTTTTATTTTTT<br>ATA*T*A*T*A*T*A*T*A*T*C*G*G*A*T*C*ACC |
| SEQ ID NO: 1223 | GATACAAAAAAAAAAATATATATATATATAAAAAAAAAA<br>ATAT*A*T*A*T*A*T*A*T*A*T*A*G*T*A*T*C |
| SEQ ID NO: 1224 | GACACAAAAAAAAAAAGATATATATATATAAAAAAAAAA<br>ATAT*A*T*A*T*A*T*A*T*A*T*C*G*T*G*T*C |
| SEQ ID NO: 1225 | GATATACAAAAAAAAAAAATATATATATATATAAAAAAAAAA<br>ATAT*A*T*A*T*A*T*A*T*A*G*T*A*T*A*T*C |
| SEQ ID NO: 1226 | GATATATAAAAAAAAAAAGATATATGTATATAAAAAAAAAA<br>ATAT*A*C*A*T*A*T*A*T*C*A*T*A*T*A*T*C |
| SEQ ID NO: 1227 | GATATACAAAAAAAAAAAGATATATATATATAAAAAAAAAA<br>ATAT*A*T*A*T*A*T*A*T*C*G*T*A*T*A*T*C |
| SEQ ID NO: 1228 | GGTATACAAAAAAAAAAATATATATATATATAAAAAAAAAA<br>ATAT*A*T*A*T*A*T*A*T*A*G*T*A*T*A*C*C |
| SEQ ID NO: 1229 | GATATATCACAAAAAAAAAAATATATATATAAAAAAAAAA<br>TATA*T*A*T*A*T*A*G*T*G*A*T*A*T*A*T*C |
| SEQ ID NO: 1230 | GTATATACATAAAAAAAAAAGATATATGTAAAAAAAAAAA<br>TACA*T*A*T*A*T*C*A*T*G*T*A*T*A*T*A*C |
| SEQ ID NO: 1231 | GGATATACATAAAAAAAAAAGATATATGTAAAAAAAAAA<br>ATACA*T*A*T*A*T*C*A*T*G*T*A*T*A*T*C*C |
| SEQ ID NO: 1232 | GGATATACATAAAAAAAAAAAGATCATGTATAAAAAAAAAA<br>ATAC*A*T*G*A*T*C*A*T*G*T*A*T*A*T*C*C |
| SEQ ID NO: 1233 | GGGTATATACAAAAAAAAAAATATATATATAAAAAAAAAA<br>TATA*T*A*T*A*T*A*G*T*A*T*A*T*A*C*C*C |
| SEQ ID NO: 1234 | GTATATACAAAAAAAAAAAATATATATATATATAAAAAAAA<br>AAAATAT*A*T*A*T*A*T*A*T*A*T*A*G*T*A*T*ATAC |
| SEQ ID NO: 1235 | GTATATACAAAAAAAAAAAGATATATATATATATAAAAAAAA<br>AAAATAT*A*T*A*T*A*T*A*T*A*T*C*G*T*A*T*ATAC |
| SEQ ID NO: 1236 | GGATATACAAAAAAAAAAAATATATATATATATATAAAAAAAA<br>AAAATAT*A*T*A*T*A*T*A*T*A*T*A*G*T*A*T*ATCC |

TABLE 1-continued

Nucleotide sequences of blocked nucleic acid molecules.

| SEQ ID NO: | Sequence |
|---|---|
| SEQ ID NO: 1237 | GGATATACAAAAAAAAAAAGATATATATATATATAAAAAAAA<br>AAAATAT*A*T*A*T*A*T*A*T*C*G*T*A*T*ATCC |
| SEQ ID NO: 1238 | GTATATACAAAAAAAAAAATATATATATATATAAAAAAAAA<br>AATATA*T*A*T*A*T*A*T*A*G*T*A*T*A*TAC |
| SEQ ID NO: 1239 | GTATATACAAAAAAAAAAGATATATATATATAAAAAAAAA<br>AATATA*T*A*T*A*T*A*T*A*T*C*G*T*A*T*A*TAC |
| SEQ ID NO: 1240 | GGATATACAAAAAAAAAAATATATATATATATAAAAAAAAA<br>AATATA*T*A*T*A*T*A*T*A*T*A*G*T*A*T*A*TCC |
| SEQ ID NO: 1241 | GGATATACAAAAAAAAAAGATATATATATATAAAAAAAAA<br>AATATA*T*A*T*A*T*A*T*A*T*C*G*T*A*T*A*TCC |
| SEQ ID NO: 1242 | GATATATCACAAAAAAAAAAATATATATATATATAAAAAAAAA<br>AATATA*T*A*T*A*T*A*T*A*G*T*G*A*T*A*T*ATC |
| SEQ ID NO: 1243 | GGATATACATAAAAAAAAAAGATATATATATAAAAAAAAA<br>AATATA*T*A*T*A*T*A*T*C*A*T*G*T*A*T*A*TCC |
| SEQ ID NO: 1244 | GTACATATATTAAAAAAAAAAGATATATATATAAAAAAAAA<br>ATATA*T*A*T*A*T*C*A*A*T*A*T*A*T*G*T*AC |
| SEQ ID NO: 1245 | GATGTATATACAAAAAAAAAAATATATATATATATAAAAAAAAA<br>ATATA*T*A*T*A*T*A*G*T*A*T*A*T*A*C*A*TC |
| SEQ ID NO: 1246 | CGATCATATATTAAAAAAAAAAGATATATATAAAAAAAAA<br>AATATA*T*A*T*A*T*C*A*A*T*A*T*A*T*G*A*TCG |
| SEQ ID NO: 1247 | CGATCATATATTAAAAAAAAAAGATATATGTAAAAAAAAA<br>AATACA*T*A*T*A*T*C*A*A*T*A*T*A*T*G*A*TCG |
| SEQ ID NO: 1248 | GATACAAAAAAAAAAATATAAATATATATATAAAAAAAAA<br>ATAT*A*T*A*T*A*T*A*T*A*T*A*G*T*A*T*C |
| SEQ ID NO: 1249 | GGATCAAAAAAAAAAATATAAATATATATATAAAAAAAAAA<br>ATAT*A*T*A*T*A*T*A*T*A*T*A*G*A*T*C*C |
| SEQ ID NO: 1250 | GACACAAAAAAAAAAAGATAAATATATATATAAAAAAAAA<br>AATAT*A*T*A*T*A*T*A*T*A*T*C*G*T*G*T*C |
| SEQ ID NO: 1251 | GACACAAAAAAAAAAAGATGATGTATATATAAAAAAAAAA<br>ATATA*T*A*T*A*C*A*T*G*A*T*C*G*T*G*T*C |
| SEQ ID NO: 1252 | GCGTCAAAAAAAAAAAGATAAATATATATATAAAAAAAAA<br>ATAT*A*T*A*T*A*T*A*T*A*T*C*G*A*C*G*C |
| SEQ ID NO: 1253 | GATATACAAAAAAAAAAATATAAATATATATAAAAAAAAA<br>ATAT*A*T*A*T*A*T*A*T*A*G*T*A*T*A*T*C |
| SEQ ID NO: 1254 | GTATATACATAAAAAAAAAAGATAAATGTAAAAAAAAAA<br>ATACA*T*A*T*A*T*C*A*T*G*T*A*T*A*T*A*C |
| SEQ ID NO: 1255 | GTATATACATAAAAAAAAAAGATGATATATAAAAAAAAAA<br>ATAT*A*T*G*A*T*C*A*T*G*T*A*T*A*T*A*C |
| SEQ ID NO: 1256 | GGATATACATAAAAAAAAAAGATAAATATAAAAAAAAAA<br>ATATA*T*A*T*A*T*C*A*T*G*T*A*T*A*T*C*C |
| SEQ ID NO: 1257 | GGATATACATAAAAAAAAAAGATGATATATAAAAAAAAAA<br>AATAT*A*T*G*A*T*C*A*T*G*T*A*T*A*T*C*C |
| SEQ ID NO: 1258 | GTATATACAAAAAAAAAAATATAAATATATATATAAAAAAAA<br>AAAATAT*A*T*A*T*A*T*A*T*A*T*A*G*T*A*T*ATAC |
| SEQ ID NO: 1259 | GTATATACAAAAAAAAAAGATAAATATATATATAAAAAAAA<br>AAAATAT*A*T*A*T*A*T*A*T*A*T*C*G*T*A*T*ATAC |
| SEQ ID NO: 1260 | GGATATACAAAAAAAAAAATATAAATATATATATAAAAAAAA<br>AAAATAT*A*T*A*T*A*T*A*T*A*T*A*G*T*A*T*ATCC |
| SEQ ID NO: 1261 | GGATATACAAAAAAAAAAGATAAATATATATATAAAAAAAA<br>AAAATAT*A*T*A*T*A*T*A*T*A*T*C*G*T*A*T*ATCC |

TABLE 1-continued

Nucleotide sequences of blocked nucleic acid molecules.

| SEQ ID NO: | Sequence |
| --- | --- |

SEQ ID NO: 1262  GTATATACAAAAAAAAAAAGATAAATGTATATAAAAAAAAAA
AATATA*T*A*C*A*T*A*T*A*T*C*G*T*A*T*A*TAC

SEQ ID NO: 1263  GGATATACAAAAAAAAAAAGATAAATGTATATAAAAAAAAA
AAATATA*T*A*C*A*T*A*T*A*T*C*G*T*A*T*A*TCC

SEQ ID NO: 1264  GGTGATACAAAAAAAAAAAGATGATGTATATATAAAAAAAAA
AAATAT*A*T*A*C*A*T*G*A*T*C*G*T*A*T*C*ACC

SEQ ID NO: 1265  GATATATCACAAAAAAAAAAATATAAATATATATAAAAAAAA
AAAATAT*A*T*A*T*A*T*A*T*A*G*T*G*A*T*A*TATC

SEQ ID NO: 1266  GTATATACATAAAAAAAAAAGATAAATATATAAAAAAAAAA
AATATA*T*A*T*A*T*A*T*C*A*T*G*T*A*T*A*TAC

SEQ ID NO: 1267  GTATATACATAAAAAAAAAAGATGATATATGTAAAAAAAAA
AAACAT*A*T*A*T*G*A*T*C*A*T*G*T*A*T*A*TAC

SEQ ID NO: 1268  GGATATACATAAAAAAAAAAAGATAAATATATAAAAAAAAAA
AAATATA*T*A*T*A*T*A*T*C*A*T*G*T*A*T*A*TCC

SEQ ID NO: 1269  GTACATATATTAAAAAAAAAAGATAAATATAAAAAAAAAAA
ATATA*T*A*T*A*T*C*A*A*T*A*T*A*T*G*T*AC

SEQ ID NO: 1270  GTACATATATTAAAAAAAAAAGATAAATGTAAAAAAAAAAA
ATACA*T*A*T*A*T*C*A*A*T*A*T*A*T*G*T*AC

SEQ ID NO: 1271  GTACATATATTAAAAAAAAAAGATGATATATAAAAAAAAAA
AATAT*A*T*G*A*T*C*A*A*T*A*T*A*T*G*T*AC

SEQ ID NO: 1272  GGATATACATAAAAAAAAAAAGATGATGAATAAAAAAAAAA
AATAC*A*T*G*A*T*C*A*T*G*T*A*T*A*T*C*C

SEQ ID NO: 1273  GTATATACATAAAAAAAAAAGATAAATGTTAAAAAAAAAA
TACA*T*A*T*A*T*C*A*T*G*T*A*T*A*T*A*C

SEQ ID NO: 1274  GATACAAAAAAAAAAAGATATAAATATATAAAAAAAAAAAA
AATAT*A*T*A*T*A*T*A*T*A*T*C*G*T*A*T*C

SEQ ID NO: 1275  GATACAAAAAAAAAAAGATGATATAAGTACTAAAAAAAAA
AAGTA*C*A*T*A*T*A*T*G*A*T*C*G*T*A*T*C

SEQ ID NO: 1276  GACACAAAAAAAAAAAGATAAATGAATATATAAAAAAAAAA
AATAT*A*T*A*C*A*T*A*T*A*T*C*G*T*G*T*C

SEQ ID NO: 1277  GGATATACAAAAAAAAAAAGATATAAGTAAATATAAAAAAA
AAAATAT*A*T*A*C*A*T*A*T*A*T*C*G*T*A*T*ATCC

SEQ ID NO: 1278  GGATATACAAAAAAAAAAAGATGATATAAGTACTAAAAAAAA
AAAAGTA*C*A*T*A*T*A*T*G*A*T*C*G*T*A*T*ATCC

SEQ ID NO: 1279  GTATATACAAAAAAAAAAAGATATAAGTAAATATAAAAAAAA
AAAATAT*A*T*A*C*A*T*A*T*A*T*C*G*T*A*T*ATAC

SEQ ID NO: 1280  GTATATACAAAAAAAAAAAGATGATATAAGTACTAAAAAAAA
AAAAGTA*C*A*T*A*T*A*T*G*A*T*C*G*T*A*T*ATAC

SEQ ID NO: 1281  GGATATACAAAAAAAAAAAGATAAATGAATATAAAAAAAAA
AAATATA*T*A*C*A*T*A*T*A*T*C*G*T*A*T*A*TCC

SEQ ID NO: 1282  GTATATACAAAAAAAAAAAGATAAATGAATATAAAAAAAAA
AAATATA*T*A*C*A*T*A*T*A*T*C*G*T*A*T*A*TAC

SEQ ID NO: 1283  GTATATACAAAAAAAAAAAGATGATATAAGTACAAAAAAAA
AAGTAC*A*T*A*T*A*T*G*A*T*C*G*T*A*T*A*TAC

SEQ ID NO: 1284  GTATATACAAAAAAAAAAATATAAATATATATTAAAAAAAA
AATATA*T*A*T*A*T*A*T*A*T*A*G*T*A*T*A*TAC

SEQ ID NO: 1285  GTATATACATAAAAAAAAAAGATGATGTAAATATAAAAAAA
AAAAATAT*A*T*A*C*A*T*G*A*T*C*A*T*G*T*A*TATAC

SEQ ID NO: 1286  GATACAAAAAAAAAAAGGATAAATATATAAAAAAAAAAAAA
AATAT*A*T*A*T*A*T*A*T*C*G*T*A*T*A*T*C

TABLE 1-continued

Nucleotide sequences of blocked nucleic acid molecules.

| SEQ ID NO: | Sequence |
| --- | --- |
| SEQ ID NO: 1287 | GTGATACAAAAAAAAAAAGATAAATATATAAAAAAAAAAA<br>AATAT*A*T*A*T*A*T*A*T*C*G*T*A*T*C*A*C |
| SEQ ID NO: 1288 | GGTATACAAAAAAAAAAAGATAAATATATAAAAAAAAAAA<br>AATAT*A*T*A*T*A*T*A*T*C*G*T*A*T*A*C*C |
| SEQ ID NO: 1289 | GGATATACATAAAAAAAAAAGATAAATGAATAAAAAAAAA<br>AAATATA*C*A*T*A*T*A*T*C*A*T*G*T*A*T*A*TCC |
| SEQ ID NO: 1290 | GTATATACATAAAAAAAAAAGATAAATGTATTAAAAAAAA<br>AATATA*C*A*T*A*T*A*T*C*A*T*G*T*A*T*A*TAC |
| SEQ ID NO: 1291 | GTATATACATAAAAAAAAAAGATGATAAATGTAAAAAAAA<br>AAACAT*A*T*A*T*G*A*T*C*A*T*G*T*A*T*A*TAC |
| SEQ ID NO: 1292 | TATATATTATTTTATTTTAATCGAGTCTTTTTGACTCGATATAC<br>AATATATA |
| SEQ ID NO: 1293 | GATATATTATTTTATTTTAATCGAGTCTTTTTGACTCGATATAC<br>AATATATC |
| SEQ ID NO: 1294 | GATATATCATTTTATTTTAATCGAGTCTTTTTGACTCGATATAC<br>GATATATC |
| SEQ ID NO: 1295 | GATATGTCATTTTATTTTAATCGAGTCTTTTTGACTCGATATAC<br>GACATATC |
| SEQ ID NO: 1296 | GTGATGTCATTTTATTTTAATCGAGTCTTTTTGACTCGATATAC<br>GACATCAC |
| SEQ ID NO: 1297 | TATATATTATTTTATTTTATGCGAGTCTTTTTGACTCGCAGCCC<br>AATATATA |
| SEQ ID NO: 1298 | GATATATTATTTTATTTTATGCGAGTCTTTTTGACTCGCAGCCC<br>AATATATC |
| SEQ ID NO: 1299 | GATATATCATTTTATTTTATGCGAGTCTTTTTGACTCGCAGCCC<br>GATATATC |
| SEQ ID NO: 1300 | GATATGTCATTTTATTTTATGCGAGTCTTTTTGACTCGCAGCCC<br>GACATATC |
| SEQ ID NO: 1301 | GTGATGTCATTTTATTTTATGCGAGTCTTTTTGACTCGCAGCCC<br>GACATCAC |
| SEQ ID NO: 1302 | TATATATTATTTTATTTTAGTATATCGGACTCGATATACAATAT<br>ATA |
| SEQ ID NO: 1303 | GATATATTATTTTATTTTAGTATATCGGACTCGATATACAATAT<br>ATC |
| SEQ ID NO: 1304 | GATATATCATTTTATTTTAGTATATCGGACTCGATATACGATAT<br>ATC |
| SEQ ID NO: 1305 | GATATGTCATTTTATTTTAGTATATCGGACTCGATATACGACAT<br>ATC |
| SEQ ID NO: 1306 | GTGATGTCATTTTATTTTAGTATATCGGACTCGATATACGACAT<br>CAC |
| SEQ ID NO: 1307 | TATATATTATTTTATTTTAGGGCTGCGGACTCGCAGCCCAATAT<br>ATA |
| SEQ ID NO: 1308 | GATATATTATTTTATTTTAGGGCTGCGGACTCGCAGCCCAATA<br>TATC |
| SEQ ID NO: 1309 | GATATATCATTTTATTTTAGGGCTGCGGACTCGCAGCCCGATA<br>TATC |
| SEQ ID NO: 1310 | GATATGTCATTTTATTTTAGGGCTGCGGACTCGCAGCCCGACA<br>TATC |
| SEQ ID NO: 1311 | GTGATGTCATTTTATTTTAGGGCTGCGGACTCGCAGCCCGACA<br>TCAC |

TABLE 1-continued

Nucleotide sequences of blocked nucleic acid molecules.

| SEQ ID NO: | Sequence |
|---|---|
| SEQ ID NO: 1312 | TATATATATTATTACTATATGGACTCGCATATAGATATATA |
| SEQ ID NO: 1313 | GATATATATTATTACTATATGGACTCGCATATAGATATATC |
| SEQ ID NO: 1314 | GATATACATTATTACTATATGGACTCGCATATAGGTATATC |
| SEQ ID NO: 1315 | GATATCCATTATTACTATATGGACTCGCATATAGGGATATC |
| SEQ ID NO: 1316 | GTGATACATTATTACTATATGGACTCGCATATAGGTATCAC |
| SEQ ID NO: 1317 | TATATATTTTATTTCGGGCTGGACTCGCAGCCCGATATATA |
| SEQ ID NO: 1318 | GATATATATTATTACGGGCTGGACTCGCAGCCCGATATATC |
| SEQ ID NO: 1319 | GATATACATTATTACGGGCTGGACTCGCAGCCCGGTATATC |
| SEQ ID NO: 1320 | GATATCCATTATTACGGGCTGGACTCGCAGCCCGGGATATC |
| SEQ ID NO: 1321 | GTGATACATTATTACGGGCTGGACTCGCAGCCCGGTATCAC |
| SEQ ID NO: 1322 | TATATATTTTATTTCTATATGTTTATTTCGAGTCTTTTGACTCGCATATAGATATATA |
| SEQ ID NO: 1323 | GATATATATTATTACTATATGATTATTACGAGTCTTTTGACTCGCATATAGATATATC |
| SEQ ID NO: 1324 | GATATACATTATTACTATATGATTATTACGAGTCTTTTGACTCGCATATAGGTATATC |
| SEQ ID NO: 1325 | GATATCCATTATTACTATATGATTATTACGAGTCTTTTGACTCGCATATAGGGATATC |
| SEQ ID NO: 1326 | GTGATACATTATTACTATATGATTATTACGAGTCTTTTGACTCGCATATAGGTATCAC |
| SEQ ID NO: 1327 | TATATATATTATTACGGGCTGATTATTACGAGTCTTTTGACTCGCAGCCCGATATATA |
| SEQ ID NO: 1328 | GATATATATTATTACGGGCTGATTATTACGAGTCTTTTGACTCGCAGCCCGATATATC |
| SEQ ID NO: 1329 | GATATACATTATTACGGGCTGATTATTACGAGTCTTTTGACTCGCAGCCCGGTATATC |
| SEQ ID NO: 1330 | GATATCCATTATTACGGGCTGATTATTACGAGTCTTTTGACTCGCAGCCCGGGATATC |
| SEQ ID NO: 1331 | GTGATACATTATTACGGGCTGATTATTACGAGTCTTTTGACTCGCAGCCCGGTATCAC |
| SEQ ID NO: 1332 | TATATATTTATTTCATATCGACTCGCAGATATGTATATA |
| SEQ ID NO: 1333 | GATATCATTATTACATATCGACTCGCAGATATGGATATC |
| SEQ ID NO: 1334 | GTGATCATTATTACATATCGACTCGCAGATATGGATCAC |
| SEQ ID NO: 1335 | GTGTGCATTATTACATATCGACTCGCAGATATGGCACAC |
| SEQ ID NO: 1336 | GATATCATTATTACCGGGCGACTCGCAGCCCGGGATATC |
| SEQ ID NO: 1337 | GTGATCATTATTACCGGGCGACTCGCAGCCCGGGATCAC |
| SEQ ID NO: 1338 | GTGTGCATTATTACCGGGCGACTCGCAGCCCGGGCACAC |
| SEQ ID NO: 1339 | TATATATTTATTTCATATCTTTATTTTGCGAGTCTTTTGACTCGCAGATATGTATATA |
| SEQ ID NO: 1340 | GATATCATTATTACATATCATTATTATGCGAGTCTTTTGACTCGCAGATATGGATATC |
| SEQ ID NO: 1341 | GTGATCATTATTACATATCATTATTATGCGAGTCTTTTGACTCGCAGATATGGATCAC |
| SEQ ID NO: 1342 | GTGTGCATTATTACATATCATTATTATGCGAGTCTTTTGACTCGCAGATATGGCACAC |

TABLE 1-continued

Nucleotide sequences of blocked nucleic acid molecules.

| SEQ ID NO: | Sequence |
| --- | --- |
| SEQ ID NO: 1343 | GATATCATTATTACCGGGCATTATTATGCGAGTCTTTTGACTCG CAGCCCGGGATATC |
| SEQ ID NO: 1344 | GTGATCATTATTACCGGGCATTATTATGCGAGTCTTTTGACTCG CAGCCCGGGATCAC |
| SEQ ID NO: 1345 | GTGTGCATTATTACCGGGCATTATTATGCGAGTCTTTTGACTCG CAGCCCGGGCACAC |
| SEQ ID NO: 1346 | GTATGATTATTACACAGGACTCGCAGCCTGTGCATAC |
| SEQ ID NO: 1347 | GTGTGATTATTACACAGGACTCGCAGCCTGTGCACAC |
| SEQ ID NO: 1348 | GTATGATTATTACCCGGGACTCGCAGCCCGGGCATAC |
| SEQ ID NO: 1349 | GTGTGATTATTACCCGGGACTCGCAGCCCGGGCACAC |
| SEQ ID NO: 1350 | GTATGATTATTACACAGATTATTAGCTGCATTATTAGAGTCTTT TGACTCGCAGCCTGTGCATAC |
| SEQ ID NO: 1351 | GTGTGATTATTACACAGATTATTAGCTGCATTATTAGAGTCTTT TGACTCGCAGCCTGTGCACAC |
| SEQ ID NO: 1352 | TATATATTATTACCCGGATTATTAGCTGCATTATTAGAGTCTTT TGACTCGCAGCCCGGGATATA |
| SEQ ID NO: 1353 | GATATATTATTACCCGGATTATTAGCTGCATTATTAGAGTCTTT TGACTCGCAGCCCGGGATATC |
| SEQ ID NO: 1354 | GTATGATTATTACCCGGATTATTAGCTGCATTATTAGAGTCTTT TGACTCGCAGCCCGGGCATAC |
| SEQ ID NO: 1355 | GTGTGATTATTACCCGGATTATTAGCTGCATTATTAGAGTCTTT TGACTCGCAGCCCGGGCACAC |
| SEQ ID NO: 1356 | GACTCGATATACAATATATAGCGCGCGCAATAAGCGCGCATT ATTAGCTATATAATTATTATTGTATAT |
| SEQ ID NO: 1357 | GACTCGATATACAATATATCGCGCGCAATAAGCGCGCATTA TTAGCGATATAATTATTATTGTATAT |
| SEQ ID NO: 1358 | GACTCGATATACGATATATCGCGCGCAATAAGCGCGCATTA TTAGCGATATAATTATTATCGTATAT |
| SEQ ID NO: 1359 | GACTCGATATACGACATATCGCGCGCAATAAGCGCGCATT ATTAGCGATATGATTATTATCGTATAT |
| SEQ ID NO: 1360 | GACTCGATATACGACATCACGCGCGCAATAAGCGCGCATT ATTAGCGTGATGATTATTATCGTATAT |
| SEQ ID NO: 1361 | GACTCGCAGCCCAATATATAGCGCGCGCAATAAGCGCGCATT ATTAGCTATATAATTATTATTGGGCTG |
| SEQ ID NO: 1362 | GACTCGCAGCCCAATATATCGCGCGCAATAAGCGCGCATT ATTAGCGATATAATTATTATTGGGCTG |
| SEQ ID NO: 1363 | GACTCGCAGCCCGATATATCGCGCGCAATAAGCGCGCATT ATTAGCGATATAATTATTATCGGGCTG |
| SEQ ID NO: 1364 | GACTCGCAGCCCGACATATCGCGCGCAATAAGCGCGCATT ATTAGCGATATGATTATTATCGGGCTG |
| SEQ ID NO: 1365 | GACTCGCAGCCCGACATCACGCGCGCAATAAGCGCGCATT ATTAGCGTGATGATTATTATCGGGCTG |
| SEQ ID NO: 1366 | GACTCGATATACAATATATAGCGCGCGCAATAAGCGCGCATT ATTAGCTATATAATTATTATTGTATATTATTAATCGAGTC |
| SEQ ID NO: 1367 | GACTCGATATACAATATATCGCGCGCAATAAGCGCGCATTA TTAGCGATATAATTATTATTGTATATTATTAATCGAGTC |
| SEQ ID NO: 1368 | GACTCGATATACGATATATCGCGCGCAATAAGCGCGCATTA TTAGCGATATAATTATTATCGTATATTATTAATCGAGTC |

TABLE 1-continued

Nucleotide sequences of blocked nucleic acid molecules.

| SEQ ID NO: | Sequence |
|---|---|
| SEQ ID NO: 1369 | GACTCGATATACGACATATCGCGCGCGCAATAAGCGCGCATT<br>ATTAGCGATATGATTATTATCGTATATTATTAATCGAGTC |
| SEQ ID NO: 1370 | GACTCGATATACGACATCACGCGCGCGCAATAAGCGCGCATT<br>ATTAGCGTGATGATTATTATCGTATATTATTAATCGAGTC |
| SEQ ID NO: 1371 | GACTCGCAGCCCAATATATAGCGCGCGCAATAAGCGCGCATT<br>ATTAGCTATATAATTATTATTGGGCATTATTATGCGAGTC |
| SEQ ID NO: 1372 | GACTCGCAGCCCAATATATCGCGCGCGCAATAAGCGCGCATT<br>ATTAGCGATATAATTATTATTGGGCATTATTATGCGAGTC |
| SEQ ID NO: 1373 | GACTCGCAGCCCGATATATCGCGCGCGCAATAAGCGCGCATT<br>ATTAGCGATATAATTATTATCGGGCATTATTATGCGAGTC |
| SEQ ID NO: 1374 | GACTCGCAGCCCGACATATCGCGCGCGCAATAAGCGCGCATT<br>ATTAGCGATATGATTATTATCGGGCATTATTATGCGAGTC |
| SEQ ID NO: 1375 | GACTCGCAGCCCGACATCACGCGCGCGCAATAAGCGCGCATT<br>ATTAGCGTGATGATTATTATCGGGCATTATTATGCGAGTC |
| SEQ ID NO: 1376 | GACTCGCATATAGATATATAGCGCGCGCAATAAGCGCGCATT<br>ATTAGCTATATATTATTAATCTATA |
| SEQ ID NO: 1377 | GACTCGCATATAGATATATCGCGCGCGCAATAAGCGCGCATTA<br>TTAGCGATATATTATTAATCTATA |
| SEQ ID NO: 1378 | GACTCGCATATAGGTATATCGCGCGCGCAATAAGCGCGCATTA<br>TTAGCGATATATTATTAACCTATA |
| SEQ ID NO: 1379 | GACTCGCATATAGGGATATCGCGCGCGCAATAAGCGCGCATT<br>ATTAGCGATATATTATTACCCTATA |
| SEQ ID NO: 1380 | GACTCGCATATAGGTATCACGCGCGCGCAATAAGCGCGCATT<br>ATTAGCGTGATATTATTAACCTATA |
| SEQ ID NO: 1381 | GACTCGCAGCCCGATATATAGCGCGCGCAATAAGCGCGCATT<br>ATTAGCTATATATTATTAATCGGGC |
| SEQ ID NO: 1382 | GACTCGCAGCCCGATATATCGCGCGCGCAATAAGCGCGCATT<br>ATTAGCGATATATTATTAATCGGGC |
| SEQ ID NO: 1383 | GACTCGCAGCCCGGTATATCGCGCGCGCAATAAGCGCGCATT<br>ATTAGCGATATATTATTAACCGGGC |
| SEQ ID NO: 1384 | GACTCGCAGCCCGGGATATCGCGCGCGCAATAAGCGCGCATT<br>ATTAGCGATATATTATTACCCGGGC |
| SEQ ID NO: 1385 | GACTCGCAGCCCGGTATCACGCGCGCGCAATAAGCGCGCATT<br>ATTAGCGTGATATTATTAACCGGGC |
| SEQ ID NO: 1386 | GACTCGCATATAGATATATAGCGCGCGCAATAAGCGCGCATT<br>ATTAGCTATATATTATTAATCTATAATTATTATGCGAGT |
| SEQ ID NO: 1387 | GACTCGCATATAGATATATCGCGCGCGCAATAAGCGCGCATTA<br>TTAGCGATATATTATTAATCTATAATTATTATGCGAGT |
| SEQ ID NO: 1388 | GACTCGCATATAGGTATATCGCGCGCGCAATAAGCGCGCATTA<br>TTAGCGATATATTATTAACCTATAATTATTATGCGAGT |
| SEQ ID NO: 1389 | GACTCGCATATAGGGATATCGCGCGCGCAATAAGCGCGCATT<br>ATTAGCGATATATTATTACCCTATAATTATTATGCGAGT |
| SEQ ID NO: 1390 | GACTCGCATATAGGTATCACGCGCGCGCAATAAGCGCGCATT<br>ATTAGCGTGATATTATTAACCTATAATTATTATGCGAGT |
| SEQ ID NO: 1391 | GACTCGCAGCCCGATATATAGCGCGCGCAATAAGCGCGCATT<br>ATTAGCTATATATTATTAATCGGGCATTATTATGCGAGT |
| SEQ ID NO: 1392 | GACTCGCAGCCCGATATATCGCGCGCGCAATAAGCGCGCATT<br>ATTAGCGATATATTATTAATCGGGCATTATTATGCGAGT |
| SEQ ID NO: 1393 | GACTCGCAGCCCGGTATATCGCGCGCGCAATAAGCGCGCATT<br>ATTAGCGATATATTATTAACCGGGCATTATTATGCGAGT |

TABLE 1-continued

Nucleotide sequences of blocked nucleic acid molecules.

| SEQ ID NO: | Sequence |
| --- | --- |
| SEQ ID NO: 1394 | GACTCGCAGCCCGGGATATCGCGCGCGCAATAAGCGCGCATT ATTAGCGATATATTATTACCCGGGCATTATTATGCGAGT |
| SEQ ID NO: 1395 | GACTCGCAGCCCGGTATCACGCGCGCGCAATAAGCGCGCATT ATTAGCGTGATATTATTAACCGGGCATTATTATGCGAGT |
| SEQ ID NO: 1396 | GACTCGCAGATATGTATATAGCGCGCGCAATAAGCGCGCATT ATTAGCTATAATTATTATACATA |
| SEQ ID NO: 1397 | GACTCGCAGATATGTATATCGCGCGCGCAATAAGCGCGCATTA TTAGCGATAATTATTATACATA |
| SEQ ID NO: 1398 | GACTCGCAGATATGGATATCGCGCGCGCAATAAGCGCGCATT ATTAGCGATAATTATTATCCATA |
| SEQ ID NO: 1399 | GACTCGCAGATATGGATCACGCGCGCGCAATAAGCGCGCATT ATTAGCGTGAATTATTATCCATA |
| SEQ ID NO: 1400 | GACTCGCAGATATGGCACACGCGCGCGCAATAAGCGCGCATT ATTAGCGTGTATTATTAGCCATA |
| SEQ ID NO: 1401 | GACTCGCAGCCCGGTATATAGCGCGCGCAATAAGCGCGCATT ATTAGCTATAATTATTATACCGG |
| SEQ ID NO: 1402 | GACTCGCAGCCCGGTATATCGCGCGCGCAATAAGCGCGCATT ATTAGCGATAATTATTATACCGG |
| SEQ ID NO: 1403 | GACTCGCAGCCCGGGATATCGCGCGCGCAATAAGCGCGCATT ATTAGCGATAATTATTATCCCGG |
| SEQ ID NO: 1404 | GACTCGCAGCCCGGGATCACGCGCGCGCAATAAGCGCGCATT ATTAGCGTGAATTATTATCCCGG |
| SEQ ID NO: 1405 | GACTCGCAGCCCGGGCACACGCGCGCGCAATAAGCGCGCATT ATTAGCGTGTATTATTAGCCCGG |
| SEQ ID NO: 1406 | GACTCGCAGCCTGTGATATAGCGCGCGCAATAAGCGCGCATT ATTAGCTATATTATTAATCAC |
| SEQ ID NO: 1407 | GACTCGCAGCCTGTGATATCGCGCGCGCAATAAGCGCGCATTA TTAGCGATATTATTAATCAC |
| SEQ ID NO: 1408 | GACTCGCAGCCTGTGCATACGCGCGCGCAATAAGCGCGCATT ATTAGCGTAATTATTATGCAC |
| SEQ ID NO: 1409 | GACTCGCAGCCTGTGCACACGCGCGCGCAATAAGCGCGCATT ATTAGCGTGATTATTATGCAC |
| SEQ ID NO: 1410 | GACTCGCAGCCCGGGATATAGCGCGCGCAATAAGCGCGCATT ATTAGCTATATTATTAATCCC |
| SEQ ID NO: 1411 | GACTCGCAGCCCGGGATATCGCGCGCGCAATAAGCGCGCATT ATTAGCGATATTATTAATCCC |
| SEQ ID NO: 1412 | GACTCGCAGCCCGGGCATACGCGCGCGCAATAAGCGCGCATT ATTAGCGTAATTATTATGCCC |
| SEQ ID NO: 1413 | GACTCGCAGCCCGGGCACACGCGCGCGCAATAAGCGCGCATT ATTAGCGTGATTATTATGCCC |
| SEQ ID NO: 1414 | GACTCGCAGCCTGTGATATAGCGCGCGCAATAAGCGCGCATT ATTAGCTATATTATTAATCACATTATTAAGGCTATTATTAGCGAG |
| SEQ ID NO: 1415 | GACTCGCAGCCTGTGATATCGCGCGCGCAATAAGCGCGCATTA TTAGCGATATTATTAATCACATTATTAAGGCTATTATTAGCGAG |
| SEQ ID NO: 1416 | GACTCGCAGCCTGTGCATACGCGCGCGCAATAAGCGCGCATT ATTAGCGTAATTATTATGCACATTATTAAGGCTATTATTAGCGAG |
| SEQ ID NO: 1417 | GACTCGCAGCCTGTGCACACGCGCGCGCAATAAGCGCGCATT ATTAGCGTGATTATTATGCACATTATTAAGGCTATTATTAGCGAG |
| SEQ ID NO: 1418 | GACTCGCAGCCCGGGATATAGCGCGCGCAATAAGCGCGCATT ATTAGCTATATTATTAATCCCATTATTAGGGCTATTATTAGCGAG |

TABLE 1-continued

Nucleotide sequences of blocked nucleic acid molecules.

SEQ ID NO:   Sequence

SEQ ID NO: 1419   GACTCGCAGCCCGGGATATCGCGCGCGCAATAAGCGCGCATT
                  ATTAGCGATATTATTAATCCCATTATTAGGGCTATTATTAGCGAG

SEQ ID NO: 1420   GACTCGCAGCCCGGGCATACGCGCGCGCAATAAGCGCGCATT
                  ATTAGCGTAATTATTATGCCCATTATTAGGGCTATTATTAGCGAG

SEQ ID NO: 1421   GACTCGCAGCCCGGGCACACGCGCGCGCAATAAGCGCGCATT
                  ATTAGCGTGATTATTATGCCCATTATTAGGGCTATTATTAGCGAG

*indicate the bonds that are phosphorothioate (PS) modified. These sequences may include nuclease resistant modifications such as PS modifications in all bases except the Loop sequences, where Loop sequences are the unhybridized bases. The number of modifications, e.g., PS, can vary from "0" to "max = total number of bases – number of bases in loops.

In any of the foregoing embodiments, the blocked nucleic acid molecules of the disclosure may further contain a reporter moiety attached thereto such that cleavage of the blocked nucleic acid releases a signal from the reporter moiety. (See FIG. 4, mechanisms depicted at center and bottom.)

Also, in any of the foregoing embodiments, the blocked nucleic acid molecule may be a modified or non-naturally occurring nucleic acid molecule. In some embodiments, the blocked nucleic acid molecules of the disclosure may further contain a locked nucleic acid (LNA), a bridged nucleic acid (BNA), and/or a peptide nucleic acid (PNA). The blocked nucleic acid molecule may contain a modified or non-naturally occurring nucleoside, nucleotide, and/or internucleoside linkage, such as a 2'-O-methyl (2'-0-Me) modified nucleoside, a 2'-fluoro (2'-F) modified nucleoside, and a phosphorothioate (PS) bond, any other nucleic acid molecule modifications described above, and any combination thereof.

FIG. 2G at left shows an exemplary single-strand blocked nucleic acid molecule and how the configuration of this blocked nucleic acid molecule is able to block R-loop formation with an RNP complex, thereby blocking activation of the trans-cleavage activity of RNP2. The single-strand blocked nucleic acid molecule is self-hybridized and comprises: a target strand (TS) sequence complementary to the gRNA (e.g., crRNA) of RNP2; a cleavable non-target strand (NTS) sequence that is partially hybridized (e.g., it contains secondary loop structures) to the TS sequence; and a protospacer adjacent motif (PAM) sequence (e.g., 5' NAAA 3') that is specifically located at the 3' end of the TS sequence. An RNP complex with 3'→5' diffusion (e.g., 1D diffusion) initiates R-loop formation upon PAM recognition. R-loop formation is completed upon a stabilizing ≥17 base hybridization of the TS to the gRNA of RNP2; however, because of the orientation of the PAM sequence relative to the secondary loop structure(s), the blocked nucleic acid molecule sterically prevents the TS sequence from hybridizing with the gRNA of RNP2, thereby blocking the stable R-loop formation required for the cascade reaction.

FIG. 2G at right shows the blocked nucleic acid molecule being unblocked via trans-cleavage (e.g., by RNP1) and subsequent dehybridization of the NTS's secondary loop structures, followed by binding of the TS sequence to the gRNA of RNP2, thereby completing stable R-loop formation and activating the trans-cleavage activity of the RNP2 complex.

In some embodiments, the blocked nucleic acid molecules provided herein are circular DNAs, RNAs or chimeric (DNA-RNA) molecules (FIG. 2H), and the blocked nucleic acid molecules may include different base compositions depending on the Cas enzyme used for RNP1 and RNP2. For the circular design of blocked nucleic acid molecules, the 5' and 3' ends are covalently linked together. This configuration makes internalization of the blocked nucleic acid molecule into RNP2—and subsequent RNP2 activation—sterically unfavorable, thereby blocking the progression of a CRISPR Cascade reaction. Thus, RNP2 activation (e.g., trans-cleavage activity) happens after cleavage of a portion of the blocked nucleic acid molecule followed by linearization and internalization of unblocked nucleic acid molecule into RNP2.

In some embodiments, the blocked nucleic acid molecules are topologically circular molecules with 5' and 3' portions hybridized to each other using DNA, RNA, LNA, BNA, or PNA bases which have a very high melting temperature (Tm). The high Tm causes the structure to effectively behave as a circular molecule even though the 5' and 3' ends are not covalently linked. The 5' and 3' ends can also have base non-naturally occurring modifications such as phosphorothioate bonds to provide increased stability.

Figure 2H:
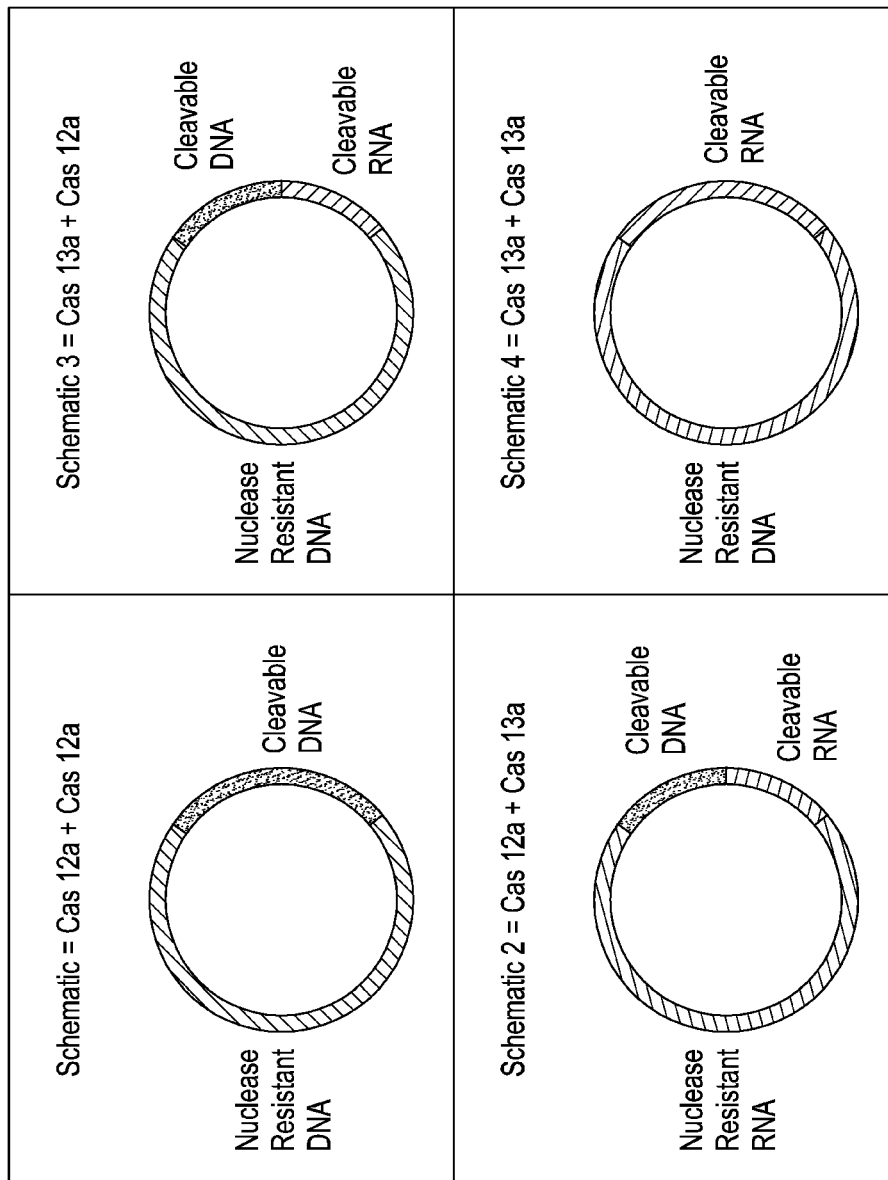
FIG. 2H shows schematics of exemplary circularized blocked nucleic acid molecules.

In embodiments where the blocked nucleic acid molecules are circularized (e.g., circular or topologically circular), as illustrated in FIG. 2H, each blocked nucleic acid molecule includes a first region, which is a target sequence specific to the gRNA of RNP2, and a second region, which is a sequence that can be cleaved by nuclease enzymes of activated RNP1 and/or RNP2. The first region may include a nuclease-resistant nucleic acid sequence such as, for example, a phosphorothioate group or other non-naturally occurring nuclease-resistant base modifications, for protection from trans-endonuclease activity. In some embodiments, when the Cas enzyme in both RNP1 and RNP2 is Cas12a, the first region of the blocked nucleic acid molecule includes a nuclease-resistant DNA sequence, and the second region of the blocked nucleic acid molecule includes a cleavable DNA sequence. In other embodiments, when the Cas enzyme in RNP1 is Cas12a and the Cas enzyme in RNP2 is Cas13a, the first region of the blocked nucleic acid molecule includes a nuclease-resistant RNA sequence, and the second region of the blocked nucleic acid molecule includes a cleavable DNA sequence and a cleavable RNA sequence. In yet other embodiments, when the Cas enzyme in RNP1 is Cas13a and the Cas enzyme in RNP2 is Cas12a, the first region of the blocked nucleic acid molecule includes a nuclease-resistant DNA sequence, and the second region of the blocked nucleic acid molecule includes a cleavable DNA sequence and a cleavable RNA sequence. In some other embodiments, when the Cas enzyme in both RNP1 and RNP2 is Cas13a, the first region of the blocked nucleic acid molecule includes a nuclease-resistant RNA sequence, and the second region of the blocked nucleic acid molecule includes a cleavable RNA sequence.

The Cascade Assay Employing Blocked Primer Molecules

The blocked nucleic acids described above may also be blocked primer molecules. Blocked primer molecules include a sequence complementary to a primer binding domain (PBD) on a template molecule (see description below in reference to FIGS. 3A and 3B) and can have the same general structures as the blocked nucleic acid molecules described above. A PBD serves as a nucleotide sequence for primer hybridization followed by primer polymerization by a polymerase. In any of Formulas I, II, or III described above, the blocked primer nucleic acid molecule may include a sequence complementary to the PBD on the 5' end of T. The unblocked primer nucleic acid molecule can bind to a template molecule at the PBD and copy the template molecule via polymerization by a polymerase.

Figure 3A:
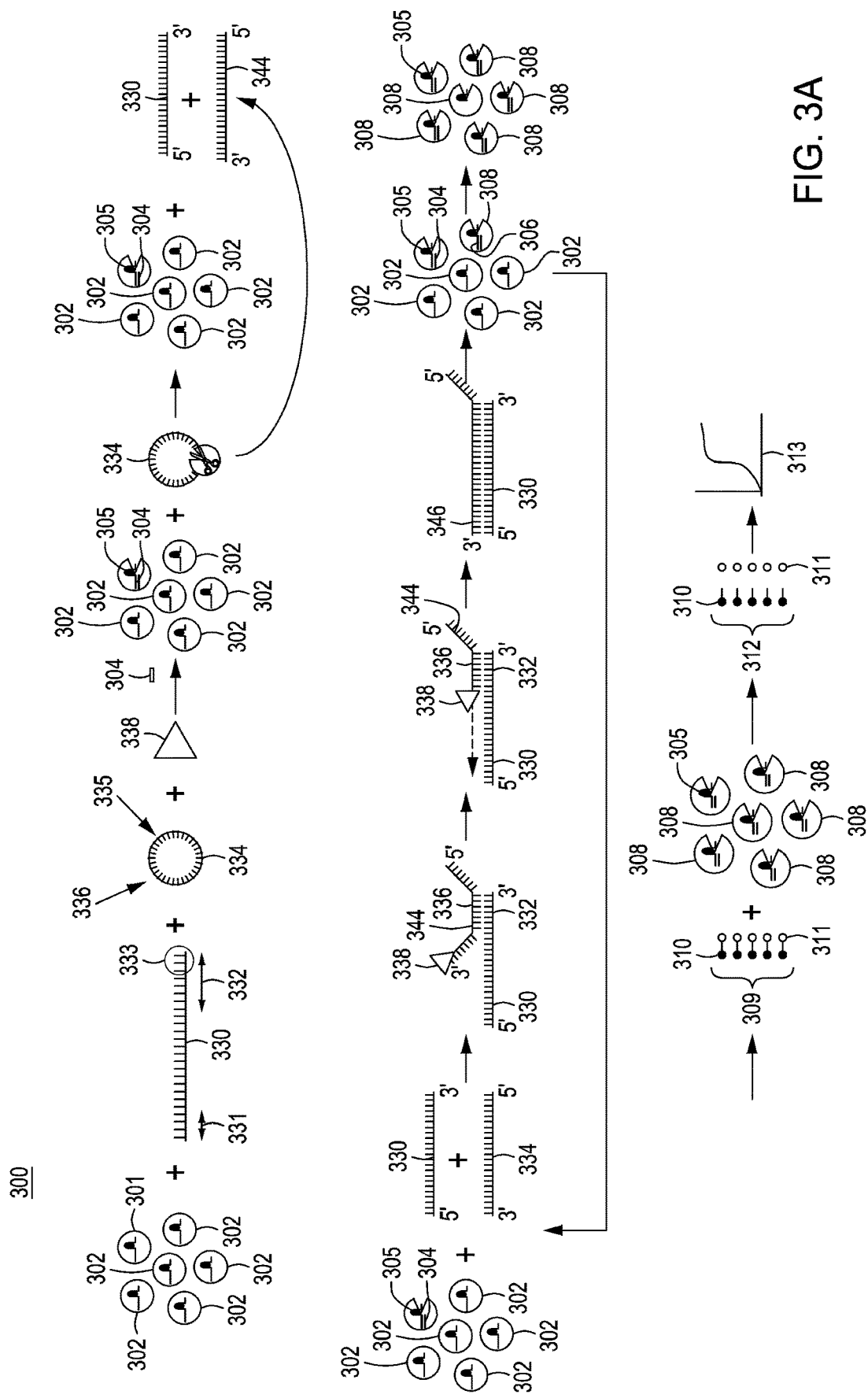
FIG. 3A is a diagram showing the sequence of steps in an exemplary cascade assay involving circular blocked primer molecules and linear template molecules.
Figure 3B:
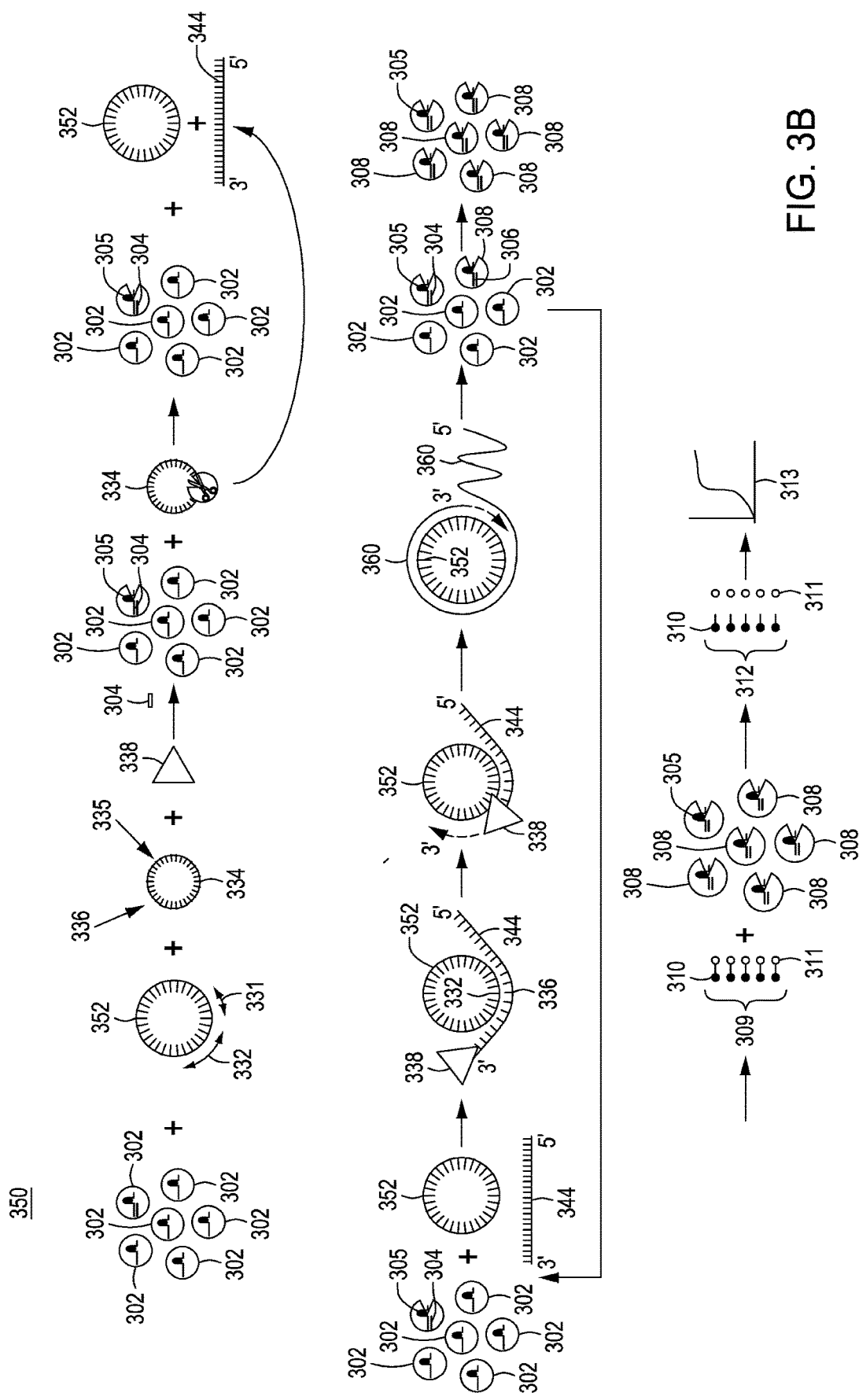
FIG. 3B is a diagram showing the sequence of steps in an exemplary cascade assay involving circular blocked primer molecules and circular template molecules.

Other specific embodiments of the cascade assay that utilize blocked primer molecules and are depicted in FIGS. 3A and 3B. In the embodiments using blocked nucleic acid molecules described above, activation of RNP1 and trans-cleavage of the blocked nucleic acid molecules were used to activate RNP2—that is, the unblocked nucleic acid molecules are a target sequence for the gRNA in RNP2. In contrast, in the embodiments using blocked primers, activation of RNP1 and trans-cleavage unblocks a blocked primer molecule that is then used to prime a template molecule for extension by a polymerase, thereby synthesizing activating molecules that are the target sequence for the gRNA in RNP2.

FIG. 3A is a diagram showing the sequence of steps in an exemplary cascade assay involving circular blocked primer molecules and linear template molecules. At left of FIG. 3A is a cascade assay reaction mix comprising 1) RNP1s (301) (only one RNP1 is shown); 2) RNP2s (302); 3) linear template molecules (330) (which is the non-target strand); 4) a circular blocked primer molecule (334) (i.e., a high $K_d$ molecule); and 5) a polymerase (338), such as a 129 polymerase. The linear template molecule (330) (non-target strand) comprises a PAM sequence (331), a primer binding domain (PBD) (332) and, optionally, a nucleoside modification (333) to protect the linear template molecule (330) from 3'→5' exonuclease activity. Blocked primer molecule (334) comprises a cleavable region (335) and a complement to the PBD (332) on the linear template molecule (330).

Upon addition of a sample comprising a target nucleic acid of interest (304) (capable of complexing with the gRNA in RNP1 (301)), the target nucleic acid of interest (304) combines with and activates RNP1 (305) but does not interact with or activate RNP2 (302). Once activated, RNP1 cuts the target nucleic acid of interest (304) via sequence specific cis-cleavage, which activates non-specific trans-cleavage of other nucleic acids present in the reaction mix, including at least one of the blocked primer molecules (334). The circular blocked primer molecule (334) (i.e., a high $K_d$ molecule, where high $K_d$ relates to binding to RNP2) upon cleavage becomes an unblocked linear primer molecule (344) (a low $K_d$ molecule, where low $K_d$ related to binding to RNP2), which has a region (336) complementary to the PBD (332) on the linear template molecule (330) and can bind to the linear template molecule (330).

Once the unblocked linear primer molecule (344) and the linear template molecule (330) are hybridized (i.e., hybridized at the PBD (332) of the linear template molecule (330) and the PBD complement (336) on the unblocked linear primer molecule (344)), 3'→5' exonuclease activity of the polymerase (338) removes the unhybridized single-stranded DNA at the end of the unblocked primer molecule (344) and the polymerase (338) can copy the linear template molecule (330) to produce a synthesized activating molecule (346) (a complement of the non-target strand, which is a target strand). The synthesized activating molecule (346) is capable of activating RNP2 (302→308). As described above, because the nucleic acid-guided nuclease in the RNP2 (308) complex exhibits (that is, possesses) both cis- and trans-cleavage activity, more blocked primer molecules (334) become unblocked primer molecules (344) triggering activation of more RNP2s (308) and more trans-cleavage activity in a cascade. As stated above in relation to blocked and unblocked nucleic acid molecules (both linear and circular), the unblocked primer molecule has a higher binding affinity for the gRNA in RNP2 than does the blocked primer molecule, although there may be some "leakiness" where some blocked primer molecules are able to interact with the gRNA in RNP2. However, an unblocked primer molecule has a substantially higher likelihood than a blocked primer molecule to hybridize with the gRNA of RNP2.

FIG. 3A at bottom depicts the concurrent activation of reporter moieties. Intact reporter moieties (309) comprise a quencher (310) and a fluorophore (311). As described above in relation to FIG. 1B, the reporter moieties are also subject to trans-cleavage by activated RNP1 (305) and RNP2 (308). The intact reporter moieties (309) become activated reporter moieties (312) when the quencher (310) is separated from the fluorophore (311), and the fluorophore emits a fluorescent signal (313). Signal strength increases rapidly as more blocked primer molecules (334) become unblocked primer molecules (344) generating synthesized activating molecules (346) and triggering activation of more RNP2 (308) complexes and more trans-cleavage activity of the reporter moieties (309). Again, here the reporter moieties are shown as separate molecules from the blocked nucleic acid molecules, but other configurations may be employed and are discussed in relation to FIG. 4. Also, as with the cascade assay embodiment utilizing blocked nucleic acid molecules that are not blocked primers, with the exception of the gRNA in RNP1, the cascade assay components stay the same no matter what target nucleic acid(s) of interest are being detected.

FIG. 3B is a diagram showing the sequence of steps in an exemplary cascade assay involving blocked primer molecules and circular template molecules. The cascade assay of FIG. 3B differs from that depicted in FIG. 3A by the configuration of the template molecule. Where the template molecule in FIG. 3A was linear, in FIG. 3B the template molecule is circular. At left of FIG. 3B is a cascade assay reaction mix comprising 1) RNP1s (301) (only one RNP1 is shown); 2) RNP2s (302); 3) a circular template molecule (352) (non-target strand); 4) a circular blocked primer molecule (334); and 5) a polymerase (338), such as a 129 polymerase. The circular template molecule (352) (non-target strand) comprises a PAM sequence (331) and a primer binding domain (PBD) (332). Blocked primer molecule (334) comprises a cleavable region (335) and a complement to the PBD (332) on the circular template molecule (352).

Upon addition of a sample comprising a target nucleic acid of interest (304) (capable of complexing with the gRNA in RNP1 (301)), the target nucleic acid of interest (304) combines with and activates RNP1 (305) but does not interact with or activate RNP2 (302). Once activated, RNP1 cuts the target nucleic acid of interest (304) via sequence specific cis-cleavage, which activates non-specific trans-cleavage of other nucleic acids present in the reaction mix, including at least one of the blocked primer molecules (334). The circular blocked primer molecule (334), upon cleavage, becomes an unblocked linear primer molecule (344), which has a region (336) complementary to the PBD (332) on the circular template molecule (352) and can hybridize with the circular template molecule (352).

Once the unblocked linear primer molecule (344) and the circular template molecule (352) are hybridized (i.e., hybridized at the PBD (332) of the circular template molecule (352) and the PBD complement (336) on the unblocked linear primer molecule (344)), 3'→5' exonuclease activity of the polymerase (338) removes the unhybridized single-stranded DNA at the 3' end of the unblocked primer molecule (344). The polymerase (338) can now use the circular template molecule (352) (non-target strand) to produce concatenated activating nucleic acid molecules (360) (which are concatenated target strands), which will be cleaved by the trans-cleavage activity of activated RNP1. The cleaved regions of the concatenated synthesized activating molecules (360) (target strand) are capable of activating the RNP2 (302→308) complex.

As described above, because the nucleic acid-guided nuclease in RNP2 (308) comprises both cis- and trans-cleavage activity, more blocked primer molecules (334) become unblocked primer molecules (344) triggering activation of more RNP2s (308) and more trans-cleavage activity in a cascade. FIG. 3B at bottom depicts the concurrent activation of reporter moieties. Intact reporter moieties (309) comprise a quencher (310) and a fluorophore (311). As described above in relation to FIG. 1B, the reporter moieties are also subject to trans-cleavage by activated RNP1 (305) and RNP2 (308). The intact reporter moieties (309) become activated reporter moieties (312) when the quencher (310) is separated from the fluorophore (311), and the fluorescent signal (313) is unquenched and can be detected. Signal strength increases rapidly as more blocked primer molecules (334) become unblocked primer molecules (344) generating synthesized activating nucleic acid molecules and triggering activation of more RNP2s (308) and more trans-cleavage activity of the reporter moieties (309). Again, here the reporter moieties are shown as separate molecules from the blocked nucleic acid molecules, but other configurations may be employed and are discussed in relation to FIG. 4. Also note that as with the other embodiments of the cascade assay, in this embodiment, with the exception of the gRNA in RNP1, the cascade assay components stay the same no matter what target nucleic acid(s) of interest are being detected.

The polymerases used in the "blocked primer molecule" embodiments serve to polymerize a reverse complement strand of the template molecule (non-target strand) to generate a synthesized activating molecule (target strand) as described above. In some embodiments, the polymerase is a DNA polymerase, such as a BST, T4, or Therminator polymerase (New England BioLabs Inc., Ipswich Mass., USA). In some embodiments, the polymerase is a Klenow fragment of a DNA polymerase. In some embodiments the polymerase is a DNA polymerase with 5'→3' DNA polymerase activity and 3'→5' exonuclease activity, such as a Type I, Type II, or Type III DNA polymerase. In some embodiments, the DNA polymerase, including the Phi29, T7, Q5®, Q5U®, Phusion®, OneTaq®, LongAmp®, Vent®, or Deep Vent® DNA polymerases (New England BioLabs Inc., Ipswich Mass., USA), or any active portion or variant thereof. Also, a 3' to 5' exonuclease can be separately used if the polymerase lacks this activity.

FIG. 4 depicts three mechanisms in which a cascade assay reaction can release a signal from a reporter moiety. FIG. 4 at top shows the mechanism discussed in relation to FIGS. 2A, 3A and 3B. In this embodiment, a reporter moiety 409 is a separate molecule from the blocked nucleic acid molecules present in the reaction mix. Reporter moiety (409) comprises a quencher (410) and a fluorophore (411). An activated reporter moiety (412) emits a signal from the fluorophore (411) once it has been physically separated from the quencher (410).

FIG. 4 at center shows a blocked nucleic acid molecule (403), which is also a reporter moiety. In addition to quencher (410) and fluorophore (411), a blocking moiety (407) can be seen (see also blocked nucleic acid molecules 203 in FIG. 2A). Blocked nucleic acid molecule/reporter moiety (403) comprises a quencher (410) and a fluorophore (411). In this embodiment of the cascade assay, when the blocked nucleic acid molecule (403) is unblocked due to trans-cleavage initiated by the target nucleic acid of interest binding to RNP1, the unblocked nucleic acid molecule (406) also becomes an activated reporter moiety with fluorophore (411) separated from quencher (410). Note both the blocking moiety (407) and the quencher (410) are removed. In this embodiment, reporter signal is directly generated as the blocked nucleic acid molecules become unblocked.

FIG. 4 at the bottom shows that cis-cleavage of an unblocked nucleic acid or a synthesized activation molecule at a PAM distal sequence by RNP2 generates a signal. Shown are activated RNP2 (408), unblocked nucleic acid molecule (461), quencher (410), and fluorophore (411) forming an activated RNP2 with the unblocked nucleic acid/reporter moiety intact (460). Cis-cleavage of the unblocked nucleic acid/reporter moiety (461) results in an activated RNP2 with the reporter moiety activated (462), comprising the activated RNP2 (408), the unblocked nucleic acid molecule with the reporter moiety activated (463), quencher (410) and fluorophore (411).

Applications of the Cascade Assay

The present disclosure describes cascade assays for detecting a target nucleic acid of interest in a sample. As described above, the various embodiments of the cascade assay are notable in that, with the exception of the gRNA in RNP1, the cascade assay components stay the same no matter what target nucleic acid(s) of interest are being detected.

Target nucleic acids of interest are derived from samples. Suitable samples for testing include, but are not limited to, any environmental sample, such as air, water, soil, surface, food, clinical sites and products, industrial sites and products, pharmaceuticals, medical devices, nutraceuticals, cosmetics, personal care products, agricultural equipment and sites, and commercial samples, and any biological sample obtained from an organism or a part thereof, such as a plant, animal, or bacteria. In some embodiments, the biological sample is obtained from an animal subject, such as a human subject. A biological sample is any solid or fluid sample obtained from, excreted by or secreted by any living organism, including, without limitation, single celled organisms, such as bacteria, yeast, protozoans, and amoebas among others, multicellular organisms including plants or animals, including samples from a healthy or apparently healthy human subject or a human patient affected by a condition or disease to be diagnosed or investigated, such as an infection with a pathogenic microorganism, such as a pathogenic bacteria or virus. For example, a biological sample can be a biological fluid obtained from, for example, blood, plasma, serum, urine, stool, sputum, mucous, lymph fluid, synovial fluid, bile, ascites, pleural effusion, seroma, saliva, cerebrospinal fluid, aqueous or vitreous humor, or any bodily secretion, a transudate, an exudate (for example, fluid obtained from an abscess or any other site of infection or inflammation), or fluid obtained from a joint (for example, a normal joint or a joint affected by disease, such as rheumatoid arthritis, osteoarthritis, gout or septic arthritis), or a swab of skin or mucosal membrane surface (e.g., a nasal or buccal swab).

In some embodiments, the sample can be a viral or bacterial sample or a biological sample that has been minimally processed, e.g., only treated with a brief lysis step prior to detection. In some embodiments, minimal processing can include thermal lysis at an elevated temperature to release nucleic acids. Suitable methods are contemplated in U.S. Pat. No. 9,493,736, among other references. Common methods for cell lysis involve thermal, chemical, enzymatic, or mechanical treatment of the sample or a combination of those. In some embodiments, minimal processing can include treating the sample with chaotropic salts such as guanidine isothiocyanate or guanidine HCl. Suitable methods are contemplated in U.S. Pat. Nos. 8,809,519, 7,893, 251, among other references. In some embodiments, minimal processing may include contacting the sample with reducing agents such as DTT or TCEP and EDTA to inactivate inhibitors and/or other nucleases present in the crude samples. In other embodiments, minimal processing for biofluids may include centrifuging the samples to obtain cell-debris free supernatant before applying the reagents. Suitable methods are contemplated in U.S. Pat. No. 8,809, 519, among other references. In still other embodiments, minimal processing may include performing DNA/RNA extraction to get purified nucleic acids before applying CRISPR Cascade reagents.

FIG. 5A shows a lateral flow assay (LFA) device that can be used to detect the cleavage and separation of a signal from a reporter moiety. For example, the reporter moiety may be a single-stranded or double-stranded oligonucleotide with terminal biotin and fluorescein amidite (FAM) modifications; and, as described above, the reporter moiety may also be part of a blocked nucleic acid. The LFA device may include a pad with binding particles, such as gold nanoparticles functionalized with anti-FAM antibodies; a control line with a first binding moiety attached, such as avidin or streptavidin; a test line with a second binding moiety attached, such as antibodies; and an absorption pad. After completion of a cascade assay (see FIGS. 2A, 3A, and 3B), the assay reaction mix is added to the pad containing the binding particles, (e.g., antibody labeled gold nanoparticles). When the target nucleic acid of interest is present, a reporter moiety is cleaved, and when the target nucleic acid of interest is absent, the reporter is not cleaved.

A moiety on the reporter binds to the binding particles and is transported to the control line. When the target nucleic acid of interest is absent, the reporter moiety is not cleaved, and the first binding moiety binds to the reporter moiety, with the binding particles attached. When the target nucleic acid of interest is present, one portion of the cleaved reporter moiety binds to the first binding moiety, and another portion of the cleaved reporter moiety bound to the binding particles via the moiety binds to the second binding moiety. In one example, anti-FAM gold nanoparticles bind to a FAM terminus of a reporter moiety and flow sequentially towards the control line and then to the test line. For reporters that are not trans-cleaved, gold nanoparticles attach to the control line via biotin-streptavidin and result in a dark control line. In a negative test, since the reporter has not been cleaved, all gold conjugates are trapped on control line due to attachment via biotin-streptavidin. A negative test will result in a dark control line with a blank test line. In a positive test, reporter moieties have been trans-cleaved by the cascade assay, thereby separating the biotin terminus from the FAM terminus. For cleaved reporter moieties, nanoparticles are captured at the test line due to anti-FAM antibodies. This positive test results in a dark test line in addition to a dark control line.

Figure 5B:
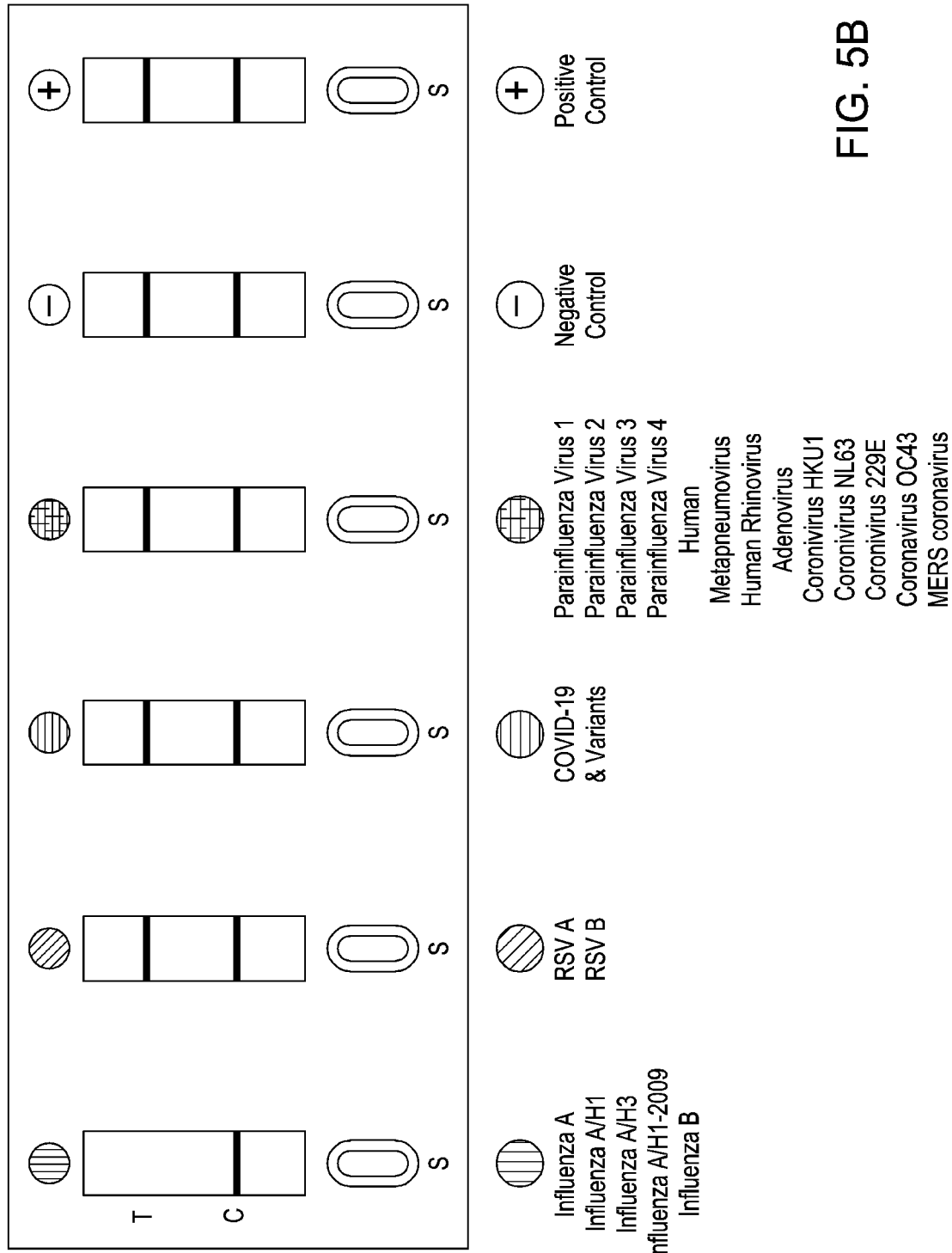
FIG. 5B shows a schematic of a lateral flow assay device illustrating the results of an exemplary syndromic test.
Figure 8:
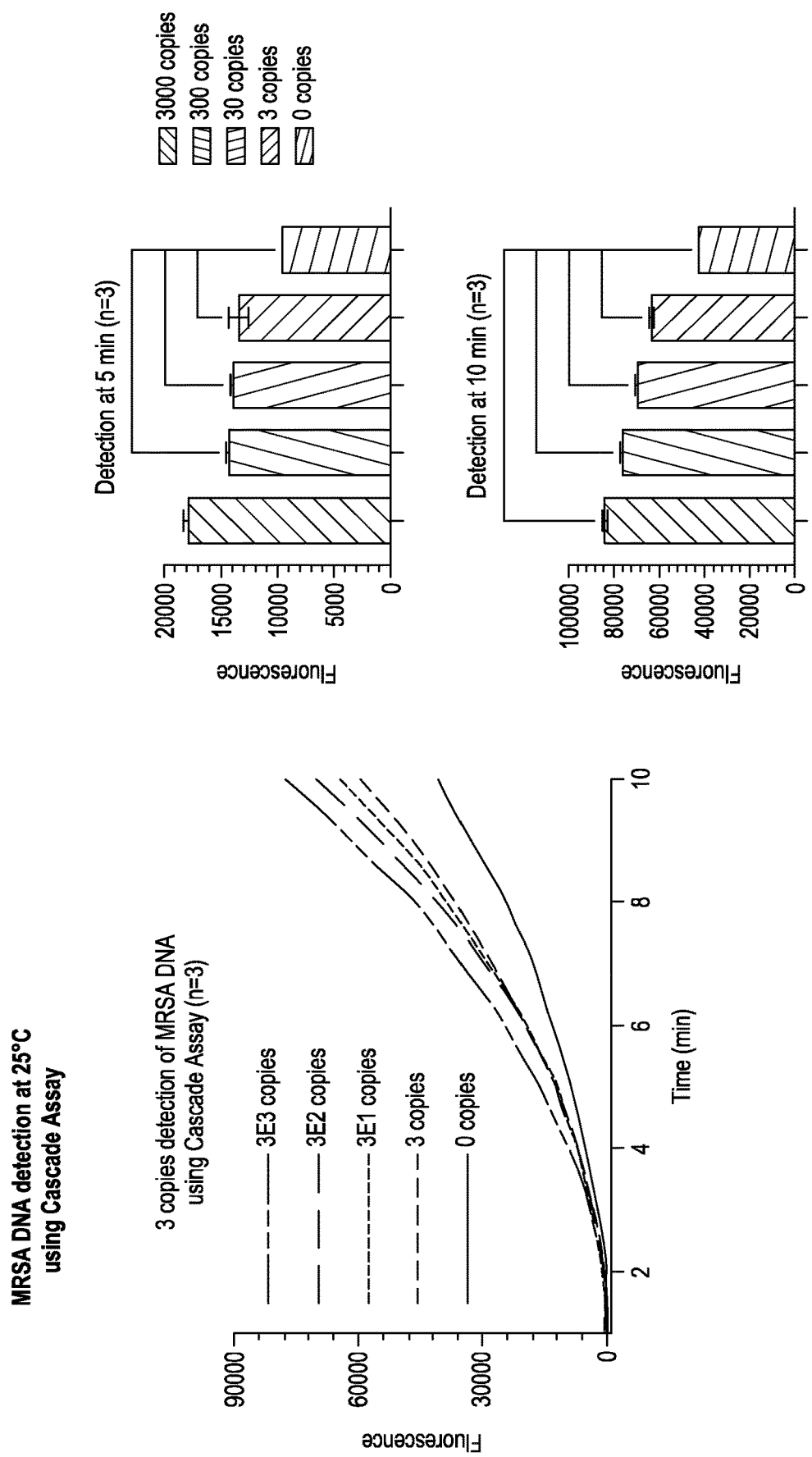
FIG. 8 shows titered quantification of DNA from Methicillin-resistant *Staphylococcus* (MRSA) using the nucleic acid detection methods described in Examples II-V.
Figure 10:
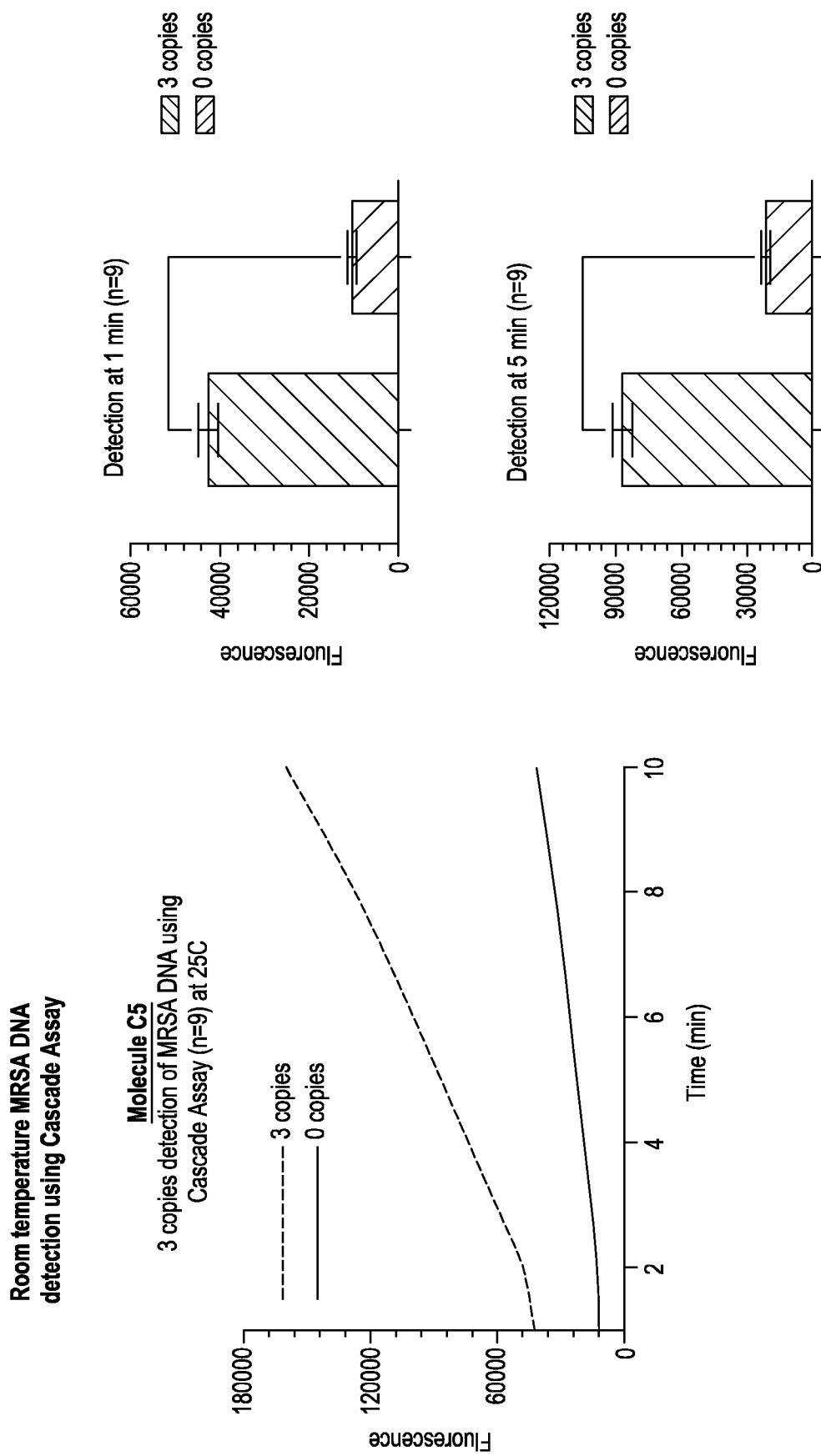
FIG. 10 shows the detection of 3 copies of a molecule of DNA from Methicillin-resistant *Staphylococcus* (MRSA) using Molecule C5 as the blocked nucleic acid molecule.
Figure 11:
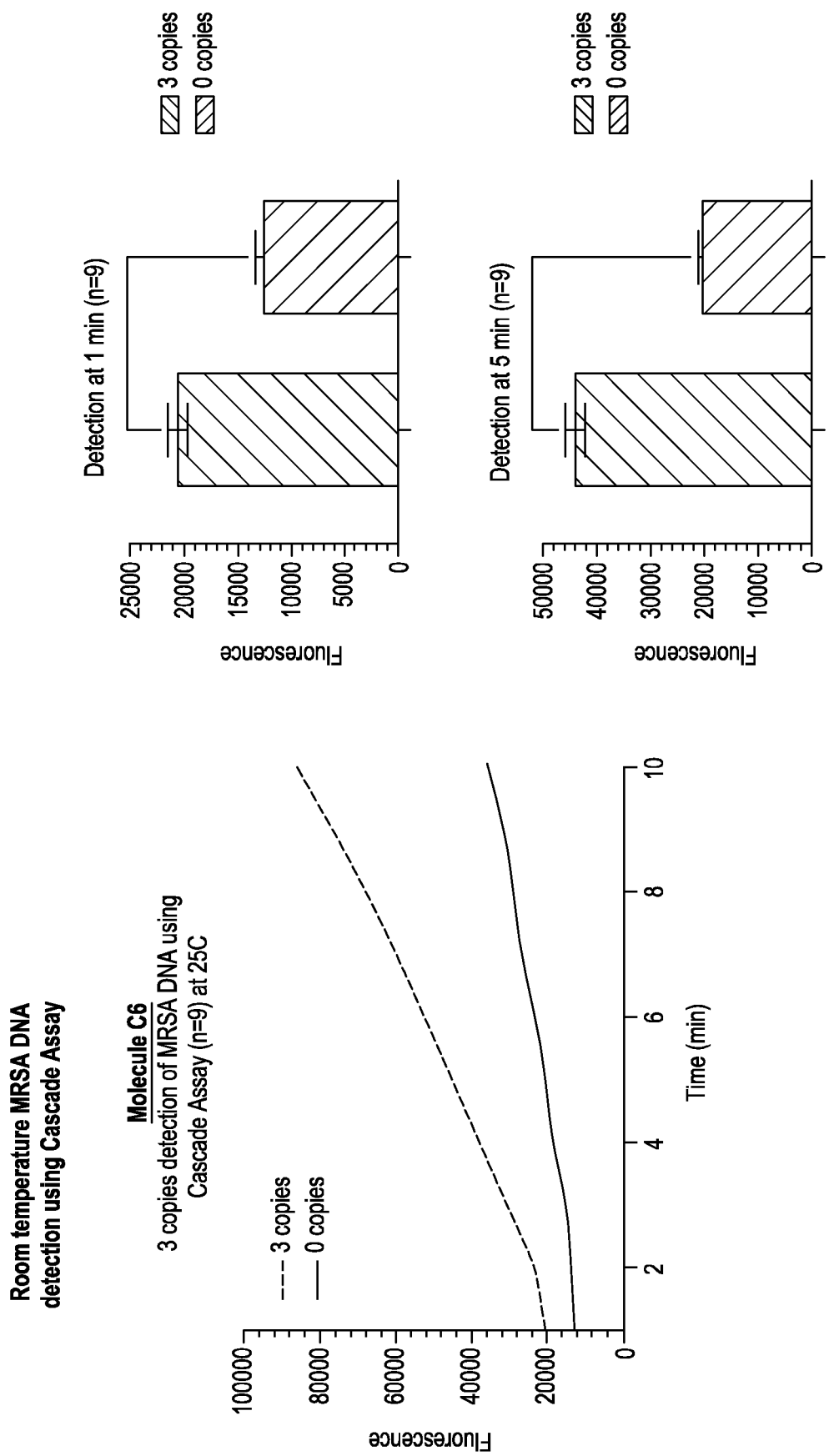
FIG. 11 shows the detection of 3 copies of a molecule of DNA from Methicillin-resistant *Staphylococcus* (MRSA) using Molecule C6 as the blocked nucleic acid molecule.
Figure 12:
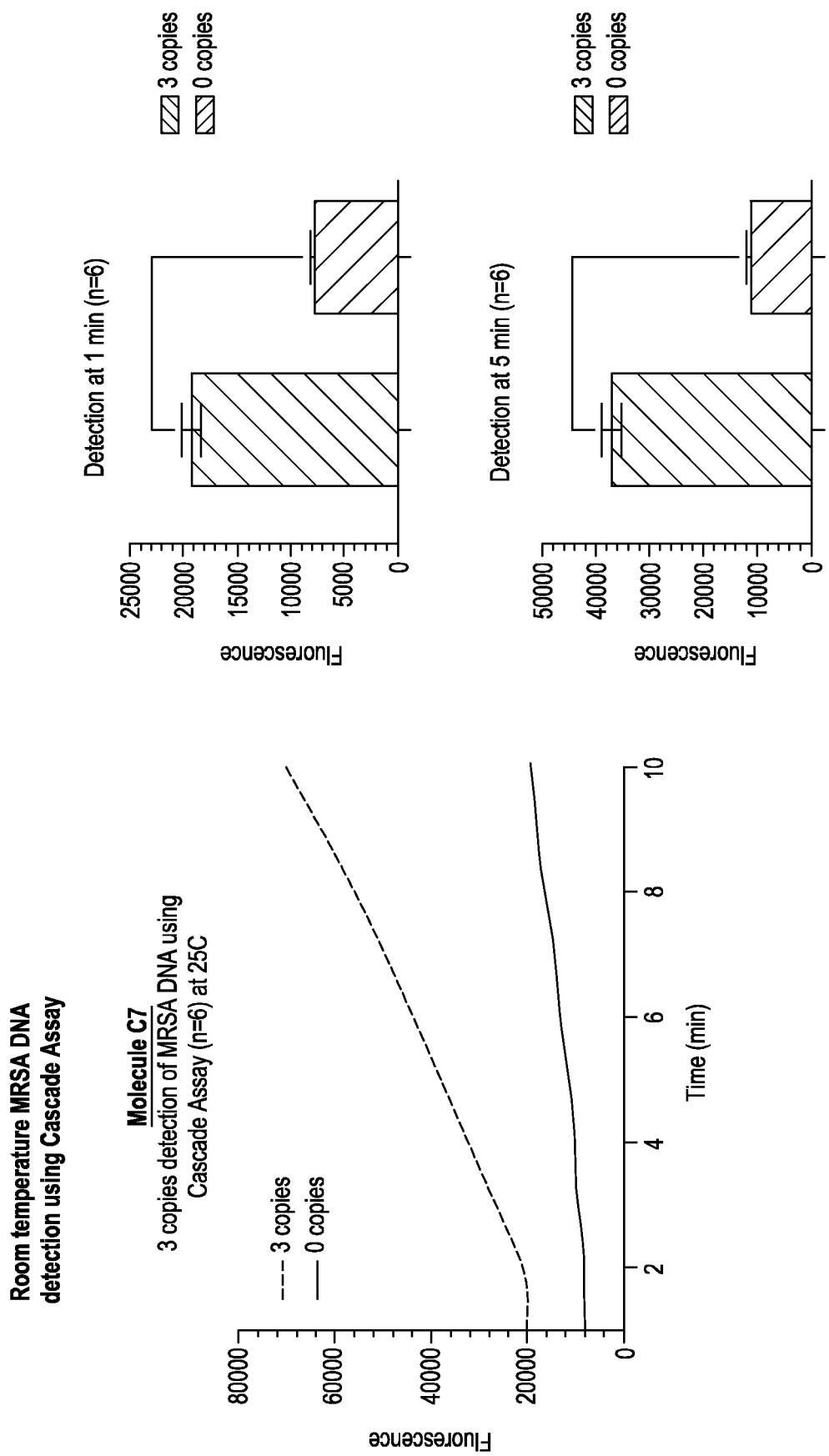
FIG. 12 shows the detection of 3 copies of a molecule of DNA from Methicillin-resistant *Staphylococcus* (MRSA) using Molecule C7 as the blocked nucleic acid molecule.
Figure 13:
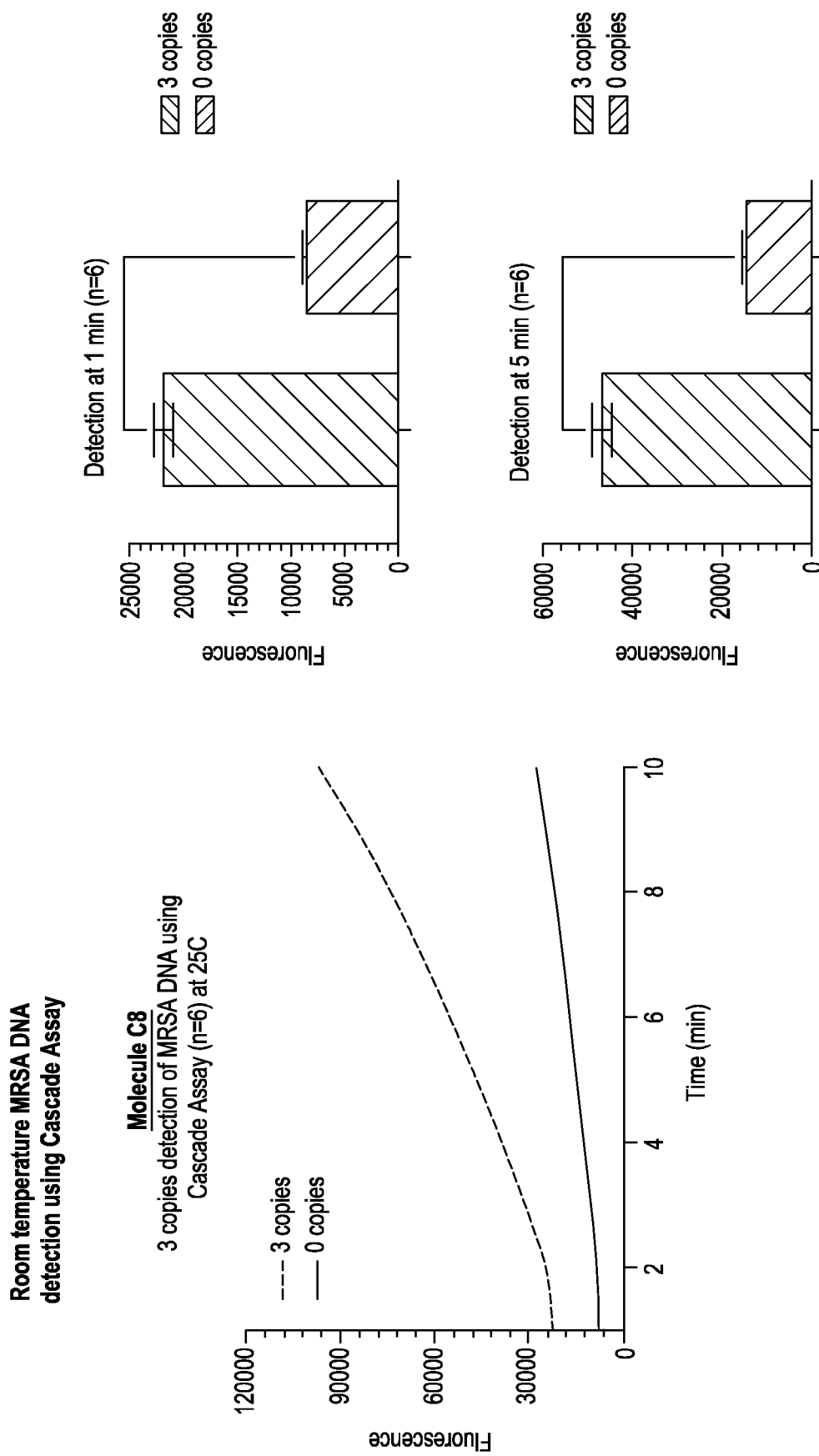
FIG. 13 shows the detection of 3 copies of a molecule of DNA from Methicillin-resistant *Staphylococcus* (MRSA) using Molecule C8 as the blocked nucleic acid molecule.
Figure 14:
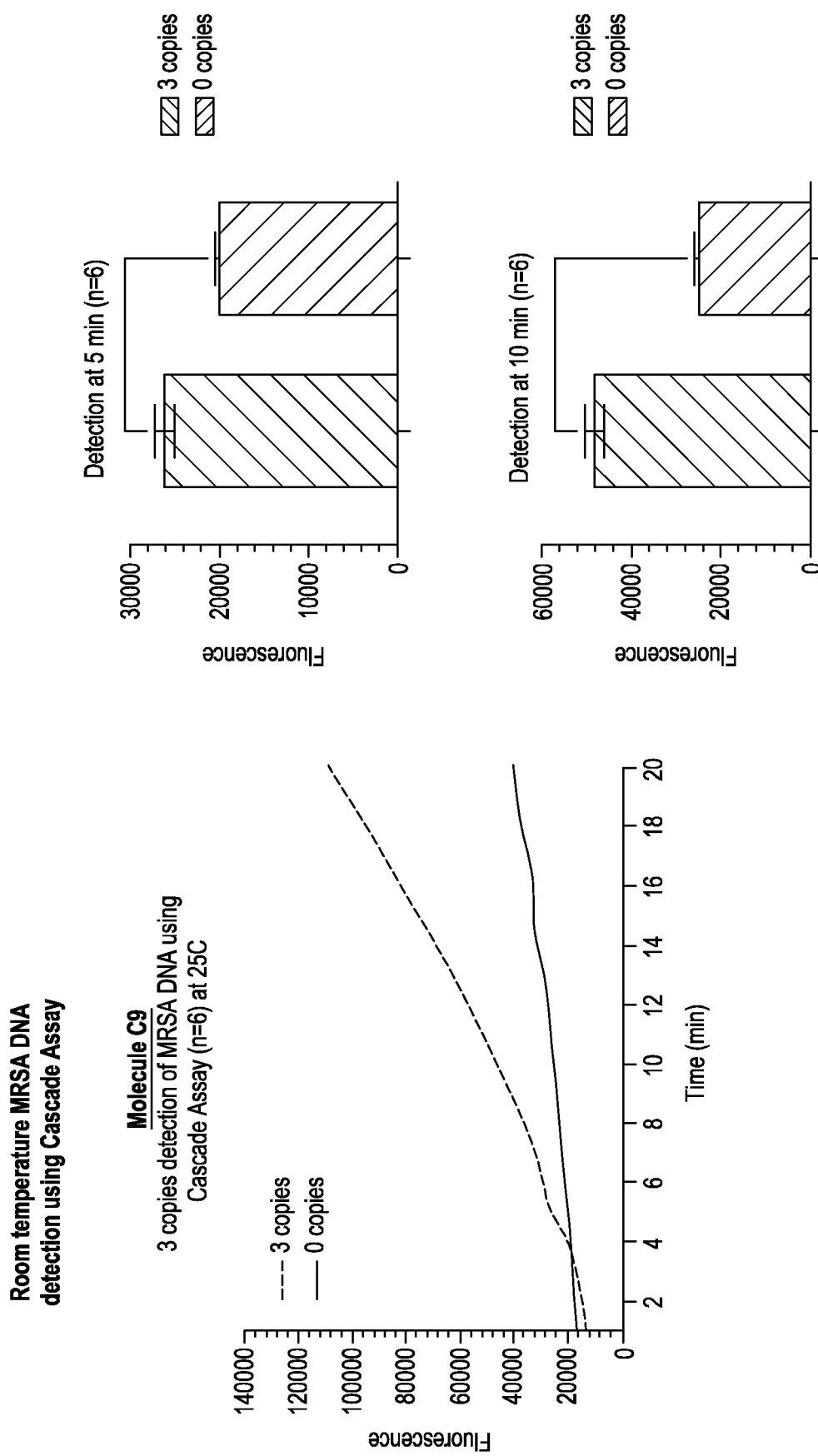
FIG. 14 shows the detection of 3 copies of a molecule of DNA from Methicillin-resistant *Staphylococcus* (MRSA) using Molecule C9 as the blocked nucleic acid molecule.

In some embodiments, the LFA device is designed for syndromic testing. For example, multiple strips with pooled RNP1s targeting different target nucleic acids of interest may be employed, either as separate devices or in a combined device. As a non-limiting example, a syndromic testing device could include four lateral flow strips, with each strip indicating the presence of at least one out of several generally related (e.g., by genetics or by treatment) pathogens (FIG. 5B). One example of a use for syndromic testing is in respiratory illness. For example, the first lateral flow strip could indicate the presence of at least one of the several strains of influenza that cause the common flu (e.g., influenza A, influenza A/H1, influenza A/H3, influenza A/H1-2009, and influenza B); the second lateral flow strip could indicate the presence of at least one of the multiple strains of respiratory syncytial virus (RSV), such as RSV-A and RSV-B; the third lateral flow strip could indicate the presence of at least one variant of SARS-CoV-2 (e.g., B.1.1.7, B.1.351, P.1, B.1.617.2, BA.1, BA.2, BA.2.12.1, BA.4, and BA.5); and the fourth lateral flow strip could indicate the presence of at least one of other pathogens of interest (e.g., parainfluenza virus 1-4, human metapneumovirus, human rhinovirus, human enterovirus, adenovirus, coronavirus HKU1, coronavirus NL63, coronavirus 229E, coronavirus OC43, MERS, and many more). The results shown in FIG. 5B indicate a positive test for the presence of RSVA and/or RSV B nucleic acid molecules. Also as seen in FIG. 5B, the syndromic testing device could further include a lateral flow strip for a negative control and a lateral flow strip for a positive control.

The components of the cascade assay may be provided in various kits. In one aspect, the kit for detecting a target nucleic acid of interest in a sample includes: first ribonucleoprotein complexes (RNP1s), second ribonucleoprotein complexes (RNP2s), blocked nucleic acid molecules, and reporter moieties. The first complex (RNP1) comprises a first nucleic acid-guided nuclease and a first gRNA, where the first gRNA includes a sequence complementary to the target nucleic acid(s) of interest. Binding of the first complex (RNP1) to the target nucleic acid(s) of interest activates trans-cleavage activity of the first nucleic acid-guided nuclease. The second complex (RNP2) comprises a second nucleic acid-guided nuclease and a second gRNA that is not complementary to the target nucleic acid of interest. The blocked nucleic acid molecule comprises a sequence complementary to the second gRNA, where trans-cleavage of the blocked nucleic acid molecule results in an unblocked nucleic acid molecule and the unblocked nucleic acid molecule can bind to the second complex (RNP2), thereby activating the trans-cleavage activity of the second nucleic acid-guided nuclease. Activating trans-cleavage activity in RNP2 results in an exponential increase in unblocked nucleic acid molecules and in active reporter moieties, where reporter moieties are nucleic acid molecules and/or are operably linked to the blocked nucleic acid molecules and produce a detectable signal upon cleavage by RNP2.

In a second aspect, the kit for detecting a target nucleic acid molecule in sample includes: first ribonucleoprotein complexes (RNP1s), second ribonucleoprotein complexes (RNP2s), template molecules, blocked primer molecules, a polymerase, NTPs, and reporter moieties. The first ribonucleoprotein complex (RNP1) comprises a first nucleic acid-guided nuclease and a first gRNA, where the first gRNA includes a sequence complementary to the target nucleic acid of interest and where binding of RNP1 to the target nucleic acid(s) of interest activates trans-cleavage activity of the first nucleic acid-guided nuclease. The second complex (RNP2) comprises a second nucleic acid-guided nuclease and a second gRNA that is not complementary to the target nucleic acid of interest. The template molecules comprise a primer binding domain (PBD) sequence as well as a sequence corresponding to a spacer sequence of the second gRNA. The blocked primer molecules comprise a sequence that is complementary to the PBD on the template nucleic acid molecule and a blocking moiety.

Upon binding to the target nucleic acid of interest, RNP1 becomes active triggering trans-cleavage activity that cuts at least one of the blocked primer molecules to produce at least one unblocked primer molecule. The unblocked primer molecule hybridizes to the PBD of one of the template nucleic acid molecules, is trimmed of excess nucleotides by the 3'-to-5' exonuclease activity of the polymerase and is then extended by the polymerase and NTPs to form a synthesized activating molecule with a sequence that is complementary to the second gRNA of RNP2. Upon activating RNP2, additional trans-cleavage activity is initiated, cleaving at least one additional blocked primer molecule. Continued cleavage of blocked primer molecules and subsequent activation of more RNP2s proceeds at an exponential rate. A signal may be generated upon cleavage of a reporter molecule by active RNP2 complexes; therefore, a change in signal production indicates the presence of the target nucleic acid molecule.

Any of the kits described herein may further include a sample collection device, e.g., a syringe, lancet, nasal swab, or buccal swab for collecting a biological sample from a subject, and/or a sample preparation reagent, e.g., a lysis reagent. Each component of the kit may be in separate container or two or more components may be in the same container. The kit may further include a lateral flow device used for contacting the biological sample with the reaction mixture, where a signal is generated to indicate the presence or absence of the target nucleic acid molecule of interest. In addition, the kit may further include instructions for use and other information.

EXAMPLES

The following examples are put forth so as to provide those of ordinary skill in the art with a complete disclosure and description of how to make and use the present invention and are not intended to limit the scope of what the inventors regard as their invention, nor are they intended to represent or imply that the experiments below are all of or the only experiments performed. It will be appreciated by persons skilled in the art that numerous variations and/or modifications may be made to the invention as shown in the specific aspects without departing from the spirit or scope of the invention as broadly described. The present aspects are, therefore, to be considered in all respects as illustrative and not restrictive.

Example I: Preparation of Nucleic Acids of Interest

Mechanical lysis: Nucleic acids of interest may be isolated by various methods depending on the cell type and source (e.g., tissue, blood, saliva, environmental sample, etc.). Mechanical lysis is a widely-used cell lysis method and may be used to extract nucleic acids from bacterial, yeast, plant and mammalian cells. Cells are disrupted by agitating a cell suspension with "beads" at high speeds (beads for disrupting various types of cells can be sourced from, e.g., OPS Diagnostics (Lebanon N.J., US) and MP Biomedicals (Irvine, Calif., USA)). Mechanical lysis via beads begins with harvesting cells in a tissue or liquid, where the cells are first centrifuged and pelleted. The supernatant is removed and replaced with a buffer containing detergents as well as lysozyme and protease. The cell suspension is mixed to promote breakdown of the proteins in the cells and the cell suspension then is combined with small beads (e.g., glass, steel, or ceramic beads) that are mixed (e.g., vortexed) with the cell suspension at high speeds. The beads collide with the cells, breaking open the cell membrane with shear forces. After "bead beating", the cell suspension is centrifuged to pellet the cellular debris and beads, and the supernatant may be purified via a nucleic acid binding column (such as the MagMAX™ Viral/Pathogen Nucleic Acid Isolation Kit from ThermoFisher (Waltham, Mass., USA) and others from Qiagen (Hilden Germany), TakaraBio (San Jose, Calif., USA), and Biocomma (Shenzen, China)) to collect the nucleic acids (see the discussion of solid phase extraction below).

Solid phase extraction (SPE): Another method for capturing nucleic acids is through solid phase extraction. SPE involves a liquid and stationary phase, which selectively separate the target analyte (here, nucleic acids) from the liquid in which the cells are suspended based on specific hydrophobic, polar, and/or ionic properties of the target analyte in the liquid and the stationary solid matrix. Silica binding columns and their derivatives are the most commonly used SPE techniques, having a high binding affinity for DNA under alkaline conditions and increased salt concentration; thus, a highly alkaline and concentrated salt buffer is used. The nucleic acid sample is centrifuged through a column with a highly porous and high surface area silica matrix, where binding occurs via the affinity between negatively charged nucleic acids and positively charged silica material. The nucleic acids bind to the silica matrices, while the other cell components and chemicals pass through the matrix without binding. One or more wash steps typically are performed after the initial sample binding (i.e., the nucleic acids to the matrix), to further purify the bound nucleic acids, removing excess chemicals and cellular components non-specifically bound to the silica matrix. Alternative versions of SPE include reverse SPE and ion exchange SPE, and use of glass particles, cellulose matrices, and magnetic beads.

Thermal lysis: Thermal lysis involves heating a sample of mammalian cells, virions, or bacterial cells at high temperatures thereby damaging the cellular membranes by denaturizing the membrane proteins. Denaturizing the membrane proteins results in the release of intracellular DNA. Cells are generally heated above 90° C., however time and temperature may vary depending on sample volume and sample type. Once lysed, typically one or more downstream methods, such as use of nucleic acid binding columns for solid phase extraction as described above, are required to further purify the nucleic acids.

Physical lysis: Common physical lysis methods include sonication and osmotic shock. Sonication involves creating and rupturing of cavities or bubbles to release shockwaves, thereby disintegrating the cellular membranes of the cells. In the sonication process, cells are added into lysis buffer, often containing phenylmethylsulfonyl fluoride, to inhibit proteases. The cell samples are then placed in a water bath and a sonication wand is placed directly into the sample solution. Sonication typically occurs between 20-50 kHz, causing cavities to be formed throughout the solution as a result of the ultrasonic vibrations; subsequent reduction of pressure then causes the collapse of the cavity or bubble resulting in a large amount of mechanical energy being released in the form of a shockwave that propagates through the solution and disintegrates the cellular membrane. The duration of the sonication pulses and number of pulses performed varies depending on cell type and the downstream application. After sonication, the cell suspension typically is centrifuged to pellet the cellular debris and the supernatant containing the nucleic acids may be further purified by solid phase extraction as described above.

Another form of physical lysis is osmotic shock, which is most typically used with mammalian cells. Osmotic shock involves placing cells in DI/distilled water with no salt added. Because the salt concentration is lower in the solution than in the cells, water is forced into the cell causing the cell to burst, thereby rupturing the cellular membrane. The sample is typically purified and extracted by techniques such as e.g., solid phase extraction or other techniques known to those of skill in the art.

Chemical lysis: Chemical lysis involves rupturing cellular and nuclear membranes by disrupting the hydrophobic-hydrophilic interactions in the membrane bilayers via detergents. Salts and buffers (such as, e.g., Tris-HCl pH8) are used to stabilize pH during extraction, and chelating agents (such as ethylenediaminetetraacetic acid (EDTA)) and inhibitors (e.g., Proteinase K) are also added to preserve the integrity of the nucleic acids and protect against degradation. Often, chemical lysis is used with enzymatic disruption methods (see below) for lysing bacterial cell walls. In addition, detergents are used to lyse and break down cellular membranes by solubilizing the lipids and membrane proteins on the surface of cells. The contents of the cells include, in addition to the desired nucleic acids, inner cellular proteins and cellular debris. Enzymes and other inhibitors are added after lysis to inactivate nucleases that may degrade the nucleic acids. Proteinase K is commonly added after lysis, destroying DNase and RNase enzymes capable of degrading the nucleic acids. After treatment with enzymes, the sample is centrifuged, pelleting cellular debris, while the nucleic acids remain in the solution. The nucleic acids may be further purified as described above.

Another form of chemical lysis is the widely-used procedure of phenol-chloroform extraction. Phenol-chloroform extraction involves the ability for nucleic acids to remain soluble in an aqueous solution in an acidic environment, while the proteins and cellular debris can be pelleted down via centrifugation. Phenol and chloroform ensure a clear separation of the aqueous and organic (debris) phases. For DNA, a pH of 7-8 is used, and for RNA, a more acidic pH of 4.5 is used.

Enzymatic lysis: Enzymatic disruption methods are commonly combined with other lysis methods such as those described above to disrupt cellular walls (bacteria and plants) and membranes. Enzymes such as lysozyme, lysostaphin, zymolase, and protease are often used in combination with other techniques such as physical and chemical lysis. For example, one can use cellulase to disrupt plant cell walls, lysosomes to disrupt bacterial cell walls and zymolase to disrupt yeast cell walls.

Example II: RNP Formation

For RNP complex formation, 250 nM of LbCas12a nuclease protein was incubated with 375 nM of a target specific gRNA in 1× Buffer (10 mM Tris-HCl, 100 µg/mL BSA) with 2-15 mM $MgCl_2$ at 25° C. for 20 minutes. The total reaction volume was 2 µL. Other ratios of LbCas12a nuclease to gRNAs were tested, including 1:1, 1:2 and 1:5. The incubation temperature can range from 20° C.-37° C., and the incubation time can range from 10 minutes to 4 hours.

Example III: Blocked Nucleic Acid Molecule Formation

Ramp cooling: For formation of the secondary structure of blocked nucleic acids, 2.504 of a blocked nucleic acid molecule (any of Formulas I-IV) was mixed in a T50 buffer (20 mM Tris HCl, 50 mM NaCl) with 10 mM $MgCl_2$ for a total volume of 50 µL. The reaction was heated to 95° C. at 1.6° C./second and incubated at 95° C. for 5 minutes to dehybridize any secondary structures. Thereafter, the reaction was cooled to 37° C. at 0.015° C./second to form the desired secondary structure.

Snap cooling: For formation of the secondary structure of blocked nucleic acids, 2.504 of a blocked nucleic acid molecule (any of Formulas I-IV) was mixed in a T50 buffer (20 mM Tris HCl, 50 mM NaCl) with 10 mM $MgCl_2$ for a total volume of 50 µL. The reaction was heated to 95° C. at 1.6° C./second and incubated at 95° C. for 5 minutes to dehybridize any secondary structures. Thereafter, the reaction was cooled to room temperature by removing the heat source to form the desired secondary structure.

Snap cooling on ice: For formation of the secondary structure of blocked nucleic acids, 2.504 of a blocked nucleic acid molecule (any of Formulas I-IV) was mixed in a T50 buffer (20 mM Tris HCl, 50 mM NaCl) with 10 mM $MgCl_2$ for a total volume of 50 µL. The reaction was heated to 95° C. at 1.6° C./second and incubated at 95° C. for 5 minutes to dehybridize any secondary structures. Thereafter, the reaction was cooled to room temperature by placing the reaction tube on ice to form the desired secondary structure.

Example IV: Reporter Moiety Formation

The reporter moieties used in the reactions herein were single-stranded DNA oligonucleotides 5-10 bases in length (e.g., with sequences of TTATT, TTTATTT, ATTAT, ATTTATTTA, AAAAA, or AAAAAAAAA) with a fluorophore and a quencher attached on the 5' and 3' ends, respectively. In one example using a Cas12a cascade, the fluorophore was FAM-6, and the quencher was IOWA BLACK® (Integrated DNA Technologies, Coralville, Iowa). In another example using a Cas13 cascade, the reporter moieties were single stranded RNA oligonucleotides 5-10 bases in length (e.g., r(U)n, r(UUAUU)n, r(A)n).

Example V: Cascade Assay

9+1 Format (final reaction mix components added at the same time): RNP1 was assembled using the LbCas12a nuclease and a gRNA for the Methicillin resistant *Staphylococcus aureus* (MRSA) DNA according to the RNP complex formation protocol described in Example II (for this sequence, see Example VIII). Briefly, 250 nM LbCas12a nuclease was assembled with 375 nM of the MRSA-target specific gRNA. Next, RNP2 was formed using the LbCas12a nuclease and a gRNA specific for a selected blocked nucleic acid molecule (Formula I-IV) using 500 nM LbCas12a nuclease assembled with 750 nM of the blocked nucleic acid-specific gRNA incubated in 1× NEB 2.1 Buffer (New England Biolabs, Ipswich, Mass.) with 5 mM $MgCl_2$ at 25° C. for 20-40 minutes. Following incubation, RNP1s were diluted to a concentration of 75 nM LbCas12a: 112.5 nM gRNA. Thereafter, the final reaction was carried out in 1× Buffer, with 500 nM of the ssDNA reporter moiety, 1× ROX dye (Thermo Fisher Scientific, Waltham, Mass.) for passive reference, 2.5 mM $MgCl_2$, 4 mM NaCl, 15 nM LbCas12a: 22.5 nM gRNA RNP1, 20 nM LbCas12a: 35 nM gRNA RNP2, and 50 nM blocked nucleic acid molecule (any one of Formula I-IV) in a total volume of 9 µL. 1 µL of MRSA DNA target (with samples having as low as three copies and as many as 30000 copies—see FIGS. 6-14) was added to make a final volume of 10 µL. The final reaction was incubated in a thermocycler at 25° C. with fluorescence measurements taken every 1 minute.

2+1+7 Format (RNP1 and MRSA target pre-incubated before addition to final reaction mix): RNP1 was assembled using the LbCas12a nuclease and a gRNA for the MRSA DNA according to RNP formation protocol described in Example II (for this sequence, see Example VIII). Briefly, 250 nM LbCas12a nuclease was assembled with 375 nM of the MRSA-target specific gRNA. Next, RNP2 was formed using the LbCas12a nuclease and a gRNA specific for a selected blocked nucleic acid molecule (Formula I-IV) using 500 nM LbCas12a nuclease assembled with 750 nM of the blocked nucleic acid-specific gRNA incubated in 1× NEB 2.1 Buffer (New England Biolabs, Ipswich, Mass.) with 5 mM $MgCl_2$ at 25° C. for 20-40 minutes. Following incubation, RNP1s were diluted to a concentration of 75 nM LbCas12a: 112.5 nM gRNA. After dilution, the formed RNP1 was mixed with 1 µL of MRSA DNA target and incubated at 20° C.-37° C. for up to 10 minutes to activate RNP1. The final reaction was carried out in 1× Buffer, with 500 nM of the ssDNA reporter moiety, 1× ROX dye (Thermo Fisher Scientific, Waltham, Mass.) for passive reference, 2.5 mM $MgCl_2$, 4 mM NaCl, the pre-incubated and activated RNP1, 20 nM LbCas12a: 35 nM gRNA RNP2, and 50 nM blocked nucleic acid molecule (any one of Formula I-IV) in a total volume of 9 µL. The final reaction was incubated in a thermocycler at 25° C. with fluorescence measurements taken every 1 minute.

2+1+6+1 Format (RNP1 and MRSA target pre-incubated before addition to final reaction mix and blocked nucleic acid molecule added to final reaction mix last): RNP1 was assembled using the LbCas12a nuclease and a gRNA for the MRSA DNA according to the RNP complex formation protocol described in Example II (for this sequence, see Example VIII). Briefly, 250 nM LbCas12a nuclease was assembled with 375 nM of the MRSA-target specific gRNA. Next, RNP2 was formed using the LbCas12a nuclease and a gRNA specific for a selected blocked nucleic acid molecule (Formula I-IV) using 500 nM LbCas12a nuclease assembled with 750 nM of the blocked nucleic acid-specific gRNA incubated in 1× NEB 2.1 Buffer (New England Biolabs, Ipswich, Mass.) with 5 mM $MgCl_2$ at 25° C. for 20-40 minutes. Following incubation, RNP1s were diluted to a concentration of 75 nM LbCas12a: 112.5 nM gRNA. After dilution, the formed RNP1 was mixed with 1 µL of MRSA DNA target and incubated at 20° C.-37° C. for up to 10 minutes to activate RNP1. The final reaction was carried out in 1× Buffer, with 500 nM of the ssDNA reporter moiety, 1× ROX dye (Thermo Fisher Scientific, Waltham, Mass.) for passive reference, 2.5 mM $MgCl_2$, 4 mM NaCl, the pre-incubated and activated RNP1, and 20 nM LbCas12a: 35 nM gRNA RNP2 in a total volume of 9 µL. Once the reaction mix was made, 1 µL (50 nM) blocked nucleic acid molecule (any one of Formula I-IV) was added for a total volume of 10 µL. The final reaction was incubated in a thermocycler at 25° C. with fluorescence measurements taken every 1 minute.

Example VI: Detection of SARS-CoV-2 with the Cascade Assay in Under 10 Minutes

To detect the presence of SARS-CoV-2 in a sample and determine the sensitivity of detection with the cascade assay, titration experiments were performed using a SARS-CoV-2 gamma-inactivated virus and a synthesized positive control. To serve as the positive control for the detection system, a plasmid containing a 316 bp SARS-CoV-2 nucleocapsid gene (N-gene) was synthesized by IDT (Integrated DNA Technologies, Coralville, Iowa). The N-gene sequence was as follows.

```
SARS-CoV-2 N-gene Target Sequence (Positive
Control; SEQ ID NO: 3):
CTCAAGGAACAACATTGCCAAAAGGCTTCTACGCAGAAGGGAGCAGAGG

CGGCAGTCAAGCCTCTTCTCGTTCCTCATCACGTAGTCGCAACAGTTCA

AGAAATTCAACTCCAGGCAGCAGTAGGGGAACTTCTCCTGCTAGAATGG

CTGGCAATGGCGGTGATGCTGCTCTTGCTTTGCTGCTGCTTGACAGATT

GAACCAGCTTGAGAGCAAAATGTCTGGTAAAGGCCAACAACAACAAGGC

CAAACTGTCACTAAGAAATCTGCTGCTGAGGCTTCTAAGAAGCCTCGGC

AAAAACGTACTGCCACTAAAGC
```

For the detection of SARS-CoV-2, a gamma-inactivated virus was incubated in a buffer at 95° C. for 1 minute in order to lyse and release viral RNA, followed by reverse transcription to convert the viral RNA to cDNA. The reverse transcription primer is designed to reverse transcribe the SARS-CoV-2 N-gene. The reverse transcription primer is as follows.

```
Reverse Transcription Primer (SEQ ID NO: 4):
GTTTGGCCTTGTTGTTGTT
```

RNP1 was preassembled with a guide RNA (gRNA) sequence designed to target the N-gene of SARS-CoV-2. The guide sequence is as follows.

```
Guide Sequence (SEQ ID NO: 5):
UAAUUUCUACUAAGUGUAGAUUUGAACUGUUGCGACUACGUGAU
```

RNP2 was preassembled with a gRNA sequence designed to target an unblocked nucleic acid molecule that results from unblocking (i.e., linearizing) a circularized blocked nucleic acid molecule. A circularized blocked nucleic acid molecule was designed and synthesized. The blocked nucleic acid molecule was as follows.

```
Blocked nucleic acid molecule (SEQ ID NO: 6):
GTT*AT*TA*AA*TG*AC*TT*CT*CATT
``` where the * indicate bonds that are phosphorothioate modified. The 5' and 3' ends were covalently linked to form a circularized molecule. The SARS-CoV-2 gamma-inactivated virus or positive control with 1700, 170, 17, or 5 total copies of N-gene DNA, or a negative control (0 copies of N-gene), were added to a reaction mixture to begin the cascade assay. The reaction mix contained the preassembled RNP1, preassembled RNP2, a blocked nucleic acid molecule in a buffer (~pH 8) containing 4 mM MgCl$_2$ and 101 mM NaCl. The buffering conditions were optimized to reduce non-specific nickase activity by the RNP complexes.

The cascade assay reaction proceeded for 20 minutes at 37° C. and fluorescence from the reporter molecule was measured. In all the SARS-CoV-2 gamma-inactivated virus and positive control titrations, a significant change in fluorescence was observed after 10 and 5 minutes, relative to the negative control (see the results in FIGS. 6 and 7). For the results shown in FIG. 6, the presence of the N-gene was detected in 10 minutes or less at 37° C. The data represent 3 independent biological replicates. Data is presented as mean±s.d. **=p<0.0001 (student t-test). For the results shown in FIG. 7, the presence of SARS-CoV-2 was detected in 10 minutes or 5 minutes at 37° C. The data represent 3 independent biological replicates. Data is presented as mean±s.d. **=p<0.0001 (student t-test). The results indicate that the cascade assay can detect as few as 5 SARS-CoV-2 target molecules in 10 minutes or less at room temperature.

Example VII: Detection of MRSA in 5 Minutes with Cascade Assay at 37° C.

To detect the presence of Methicillin resistant *Staphylococcus aureus* (MRSA) and determine the sensitivity of detection with the cascade assay, titration experiments with a MRSA DNA target nucleic acid of interest were performed. The MRSA DNA sequence (NCBI Reference Sequence NC: 007793.1) is as follows.

```
SEQ ID NO: 7:
ATGAAAAAGATAAAAATTGTTCCACTTATTTTAATAGTTGTAGTTGT

CGGGTTTGGTATATATTTTTATGCTTCAAAAGATAAAGAAATTAATA

ATACTATTGATGCAATTGAAGATAAAAATTTCAAACAAGTTTATAAA

GATAGCAGTTATATTTCTAAAAGCGATAATGGTGAAGTAGAAATGAC

TGAACGTCCGATAAAAATATATAATAGTTTAGGCGTTAAAGATATAA

ACATTCAGGATCGTAAAATAAAAAAAGTATCTAAAAATAAAAAACGA

GTAGATGCTCAATATAAAATTAAAACAAACTACGGTAACATTGATCG

CAACGTTCAATTTAATTTTGTTAAAGAAGATGGTATGTGGAAGTTAG

ATTGGGATCATAGCGTCATTATTCCAGGAATGCAGAAAGACCAAAGC

ATACATATTGAAAATTTAAAATCAGAACGTGGTAAAATTTTAGACCG

AAACAATGTGGAATTGGCCAATACAGGAACAGCATATGAGATAGGCA

TCGTTCCAAAGAATGTATCTAAAAAAGATTATAAAGCAATCGCTAAA

GAACTAAGTATTTCTGAAGACTATATCAAACAACAAATGGATCAAAA

TTGGGTACAAGATGATACCTTCGTTCCACTTAAAACCGTTAAAAAAA

TGGATGAATATTTAAGTGATTTCGCAAAAAAATTTCATCTTACAACT

AATGAAACAGAAAGTCGTAACTATCCTCTAGGAAAAGCGACTTCACA

TCTATTAGGTTATGTTGGTCCCATTAACTCTGAAGAATTAAAACAAA

AAGAATATAAAGGCTATAAAGATGATGCAGTTATTGGTAAAAAGGGA

CTCGAAAAACTTTACGATAAAAAGCTCCAACATGAAGATGGCTATCG

TGTCACAATCGTTGACGATAATAGCAATACAATCGCACATACATTAA
```

```
-continued
TAGAGAAAAAGAAAAAAGATGGCAAAGATATTCAACTAACTATTGAT

GCTAAAGTTCAAAAGAGTATTTATAACAACATGAAAAATGATTATGG

CTCAGGTACTGCTATCCACCCTCAAACAGGTGAATTATTAGCACTTG

TAAGCACACCTTCATATGACGTCTATCCATTTATGTATGGCATGAGT

AACGAAGAATATAATAAATTAACCGAAGATAAAAAAGAACCTCTGCT

CAACAAGTTCCAGATTACAACTTCACCAGGTTCAACTCAAAAAATAT

TAACAGCAATGATTGGGTTAAATAACAAAACATTAGACGATAAAACA

AGTTATAAAATCGATGGTAAAGGTTGGCAAAAAGATAAATCTTGGGG

TGGTTACAACGTTACAAGATATGAAGTGGTAAATGGTAATATCGACT

TAAAACAAGCAATAGAATCATCAGATAACATTTTCTTTGCTAGAGTA

GCACTCGAATTAGGCAGTAAGAAATTTGAAAAAGGCATGAAAAAACT

AGGTGTTGGTGAAGATATACCAAGTGATTATCCATTTTATAATGCTC

AAATTTCAAACAAAAATTTAGATAATGAAATATTATTAGCTGATTCA

GGTTACGGACAAGGTGAAATACTGATTAACCCAGTACAGATCCTTTC

AATCTATAGCGCATTAGAAAATAATGGCAATATTAACGCACCTCACT

TATTAAAAGACACGAAAAACAAAGTTTGGAAGAAAAATATTATTTCC

AAAGAAAATATCAATCTATTAACTGATGGTATGCAACAAGTCGTAAA

TAAAACACATAAAGAAGATATTTATAGATCTTATGCAAACTTAATTG

GCAAATCCGGTACTGCAGAACTCAAAATGAAACAAGGAGAAACTGGC

AGACAAATTGGGTGGTTTATATCATATGATAAAGATAATCCAAACAT

GATGATGGCTATTAATGTTAAAGATGTACAAGATAAAGGAATGGCTA

GCTACAATGCCAAAATCTCAGGTAAAGTGTATGATGAGCTATATGAG

AACGGTAATAAAAAATACGATATAGATGAATAA
```

Briefly, an RNP1 was preassembled with a gRNA sequence designed to target MRSA DNA. Specifically, RNP1 was designed to target a 20 bp region of the mecA gene of MRSA: TGTATGGCATGAGTAACGAA (SEQ ID NO: 8). An RNP2 was preassembled with a gRNA sequence designed to target an unblocked nucleic acid molecule that results from unblocking (i.e., linearizing) a circularized blocked nucleic acid molecule. The circularized blocked nucleic acid molecule was designed and synthesized (SEQ ID NO: 6): GTT*AT*TA*AA*TG*AC*TT*CT*CATT, where the * indicate bonds that are phosphorothioate modified. The 5' and 3' ends were covalently linked to form a circularized molecule. MRSA DNA (SEQ ID NO: 7) with 3000, 300, 30, or 3 total copies, or a negative control (e.g., 0 copies), were added to a reaction mixture to begin the cascade assay. The reaction mix contained the preassembled RNP1, preassembled RNP2, and a circularized blocked nucleic acid molecule, in a buffer (pH of about 8) containing 4 mM MgCl$_2$ and 101 mM NaCl. The buffering conditions were optimized to reduce non-specific nickase activity by the RNP complexes. The cascade assay proceeded for 10 minutes at 37° C., and fluorescence from the reporter moiety was measured. In all titrations, a significant change in fluorescence was observed after 10 and 5 minutes, relative to the negative control (see the results in FIG. 8). The cascade assay was initiated to identify the presence of MRSA in 10 minutes or 5 minutes at 37° C. Data represent 3 independent biological replicates. Data is presented as mean±s.d. ****=p<0.0001 (student t-test). The results indicate that the cascade assay can detect as few as 3 MRSA target molecules in only 5 minutes when at 37° C.

Example VIII: Detection of MRSA in Under 10 Minutes with a Cascade Assay at 25° C.

To detect the presence of MRSA and determine the sensitivity of detection with the cascade assay, titration experiments with MRSA DNA (SEQ ID NO: 7) were performed.

Briefly, an RNP1 was preassembled with a guide RNA (gRNA) sequence designed to target MRSA DNA. Specifically, RNP1 was designed to target the following 20 bp sequence in the mecA gene of MRSA: TGTATGGCATGAGTAACGAA (SEQ ID NO: 8). An RNP2 was preassembled with a gRNA sequence designed to target an unblocked nucleic acid molecule that results from unblocking (i.e., linearizing) a circularized blocked nucleic acid molecule. A circularized blocked nucleic acid molecule was designed and synthesized (SEQ ID NO: 6): GTT*AT*TA*AA*TG*AC*TT*CT*CATT, where the * indicate bonds that are phosphorothioate modified. The 5' and 3' ends were covalently linked to form a circularized molecule.

MRSA DNA (SEQ ID NO: 7) with 30000, 3000, 300, 30, or 3 total copies, or a negative control (e.g., 0 copies), was added to a reaction mixture to begin the cascade assay. The reaction mix contained the preassembled RNP1, preassembled RNP2, the circularized blocked nucleic acid molecule in a buffer (— pH 8) containing 4 mM MgCl$_2$ and 101 mM NaCl. The buffering conditions were optimized to reduce non-specific nickase activity by the RNP complexes. The cascade reaction proceeded for 20 minutes at 25° C., and fluorescence by the reporter molecule was measured. In all titrations, a significant change in fluorescence was observed after 10 and 5 minutes, relative to the negative control (see the results in FIG. 9), indicating that the cascade assay can detect as few as 3 MRSA target molecules in 10 minutes or less while at room temperature. The data represent 3 independent biological replicates and is presented as mean±s.d. ****=p<0.0001 (student t-test).

Example IX: Optimized Detection of MRSA in 1 Minute with the Cascade Assay at 25° C.

RNP1 was preassembled with a gRNA sequence designed to target MRSA DNA (SEQ ID NO: 7). Specifically, RNP1 was designed to target the following 20 bp sequence in the mecA gene of MRSA: TGTATGGCATGAGTAACGAA (SEQ ID NO: 8). RNP2 was preassembled with a gRNA sequence designed to target an unblocked nucleic acid molecule that results from unblocking a blocked nucleic acid molecule. Five different double stranded and linear blocked nucleic acid molecules were designed, synthesized, and tested: molecule C5, molecule C6, molecule C7, molecule C8, and molecule C9. The nucleotide sequences of molecules C5-C9 are as follows.

C5 (SEQ ID NO: 9):
GTTATTGAGAATTATTGTCATATTATTCTAATATTATTAAGGCTTATT

CACTGTTATTATTATAATTATTAAGCTTATT

C6 (SEQ ID NO: 10):
GTTATTGAGAAGTTATTATCATCTATTATTAATAAGTTATTGCCACTA

TTATTGTTATAATTATTAAGCTTATT

C7 (SEQ ID NO: 11):
GTTATTGAGAAGTATTATTCATCTAATTATTATAAGGCCTTATTACTG

TTATTATTAATAAGCTTATT

C8 (SEQ ID NO: 12):
GTTATTGAGAAGTCTTATTATCTAATATTATTAGGCCACTGTTATTAT

TATAATAAGCTTATT

C9 (SEQ ID NO: 13):
GTTATTGAGAAGTCATTATTATCTAATAAGTTATTGCCACTGTTATTA

TTATAATAAGCTTATT

Three copies of MRSA DNA (SEQ ID NO: 7) or a negative control (e.g., 0 copies) were added to a reaction mix to begin the cascade assay. The reaction mix contained the preassembled RNP1, preassembled RNP2, and one of the five blocked nucleic acid molecules in a buffer (~pH 8) containing 4 mM MgCl$_2$ and 71 mM NaCl. These buffering conditions were optimized to reduce non-specific nickase activity by the RNP complexes. Each cascade assay proceeded for 10-20 minutes at 25° C., and fluorescence by the reporter molecule was measured for each cascade assay containing C5 (see the results shown in FIG. 10, where the the presence of just 3 MRSA targets was detected in 5 minutes or less at 25° C. The data represent 9 independent biological replicates and is presented as mean±s.d. **=p<0.0001 (student t-test), molecule C6 (see the results shown in FIG. 11, where the presence of just 3 MRSA targets was detected in 5 minutes or less at 25° C. The data represent 6 independent biological replicates and is presented as mean±s.d. =p<0.0001 (student t-test)), molecule C7 (see the results shown in FIG. 12, where the presence of just 3 MRSA targets was detected in 5 minutes or less at 25° C. Data represent 6 independent biological replicates and is presented as mean±s.d. =p<0.0001 (student t-test)), molecule C8 (see the results shown in FIG. 13, where the presence of just 3 MRSA targets was detected in 5 minutes or less at 25° C. Data represent 6 independent biological replicates and is presented as mean±s.d. =p<0.0001 (student t-test)), and molecule C9 (see the results shown in FIG. 14, where the presence of just 3 MRSA targets was detected in 10 minutes or less at 25° C. Data represent 6 independent biological replicates and data is presented as mean±s.d. **=p<0.0001 (student t-test)). A significant change in fluorescence is observed after 1 minute and after 5 minutes, relative to the negative control, indicating that the cascade assay can be optimized to detect as few as 3 MRSA target molecules in as little as 1 minute while at room temperature.

While certain embodiments have been described, these embodiments have been presented by way of example only and are not intended to limit the scope of the present disclosures. Indeed, the novel methods, apparatuses, modules, instruments and systems described herein can be embodied in a variety of other forms; furthermore, various omissions, substitutions and changes in the form of the methods, apparatuses, modules, instruments and systems described herein can be made without departing from the spirit of the present disclosures. The accompanying claims and their equivalents are intended to cover such forms or modifications as would fall within the scope and spirit of the present disclosures.

SEQUENCE LISTING (1421 sequences)

SEQ ID NO: 1 - DNA, 12 bp, synthetic construct
  source 1..12: mol_type = other DNA
agctagctagct

SEQ ID NO: 2 - DNA, 10 bp, synthetic construct
  source 1..10: mol_type = other DNA
gctagctagc

SEQ ID NO: 3 - DNA, 316 bp, synthetic construct
  source 1..316: mol_type = other DNA
ctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagc

SEQ ID NO: 4 - DNA, 19 bp, synthetic construct
  source 1..19: mol_type = other DNA
gtttggccttgttgttgtt

SEQ ID NO: 5 - RNA, 44 nt, synthetic construct
  source 1..44: mol_type = other RNA
taatttctactaagtgtagatttgaactgttgcgactacgtgat

SEQ ID NO: 6 - DNA, 21 bp, synthetic construct
  source 1..21: mol_type = other DNA
  modified_base 3: mod_base = OTHER; note = Thymine phosphorothioate
  modified_base 5: mod_base = OTHER; note = Thymine phosphorothioate
  modified_base 7: mod_base = OTHER; note = Adenine phosphorothioate
  modified_base 9: mod_base = OTHER; note = Adenine phosphorothioate
  modified_base 11: mod_base = OTHER; note = Guanosine phosphorothioate
  modified_base 13: mod_base = OTHER; note = Cytosine phosphorothioate
  modified_base 15: mod_base = OTHER; note = Thymine phosphorothioate
  modified_base 17: mod_base = OTHER; note = Thymine phosphorothioate
gttattaaatgacttctcatt

SEQ ID NO: 7 - DNA, 2007 bp, Staphylococcus aureus
  source 1..2007: mol_type = genomic DNA
atgaaaaagataaaaattgttccacttattttaatagttgtagttgtcgggtttggtatatatttttatgcttcaaaagataaagaaattaataatactattgatgcaattgaagataaaaatttcaaacaagtttataaagatagcagttatatttctaaaagcgataatggtgaagtagaaatgactgaacgtccgataaaaatatataatagtttaggcgttaaagatataaacattcaggatcgtaaaataaaaaaagtatctaaaaataaaaaacgagtagatgctcaatataaaattaaaacaaactacggtaacattgatcgcaacgttcaatttaattttgttaaagaagatggtatgtggaagttagattgggatcatagcgtcattattccaggaatgcagaaagaccaaagcatacatattgaaaatttaaaatcagaacgtggtaaaattttagaccgaaacaatgtggaattggccaatacaggaacagcatatgagataggcatcgttccaaagaatgtatctaaaaaagattataaagcaatcgctaaagaactaagtatttctgaagactatatcaaacaacaaatggatcaaaattgggtacaagatgataccttcgttccacttaaaaccgttaaaaaaatggatgaatatttaagtgatttcgcaaaaaaatttcatcttacaactaatgaaacagaaagtcgtaactatcctctaggaaaagcgacttcacatctattaggttatgttggtcccattaactctgaagaattaaaacaaaaagaatataaaggctataaagatgatgcagttattggtaaaaagggactcgaaaaactttacgataaaaagctccaacatgaagatggctatcgtgtcacaatcgttgacgataatagcaatacaatcgcacatacattaatagagaaaaagaaaaaagatggcaaagatattcaactaactattgatgctaaagttcaaaagagtatttataacaacatgaaaaatgattatggctcaggtactgctatccaccctcaaacaggtgaattattagcacttgtaagcacaccttcatatgacgtctatccatttatgtatggcatgagtaacgaagaatataataaattaaccgaagataaaaaagaacctctgctcaacaagttccagattacaacttcaccaggttcaactcaaaaaatattaacagcaatgattgggttaaataacaaaacattagacgataaaacaagttataaaatcgatggtaaaggttggcaaaaagataaatcttggggtggttacaacgttacaagatatgaagtggtaaatggtaatatcgacttaaaacaagcaatagaatcatcagataacattttctttgctagagtagcactcgaattaggcagtaagaaatttgaaaaaggcatgaaaaaactaggtgttggtgaagatataccaagtgattatccattttataatgctcaaatttcaaacaaaaatttagataatgaaatattattagctgattcaggttacggacaaggtgaaatactgattaacccagtacagatcctttcaatctatagcgcattagaaaataatggcaatattaacgcacctcacttattaaaagacacgaaaaacaaagtttggaagaaaaatattatttccaaagaaaatatcaatctattaactgatggtatgcaacaagtcgtaaataaaacacataaagaagatatttatagatcttatgcaaacttaattggcaaatccggtactgcagaactcaaaatgaaacaaggagaaactggcagacaaattgggtggtttatatcatatgataaagataatccaaacatgatgatggctattaatgttaaagatgtacaagataaaggaatggctagctacaatgccaaaatctcaggtaaagtgtatgatgagctatatgagaacggtaataaaaaatacgatatagatgaataa

SEQ ID NO: 8 - DNA, 20 bp, synthetic construct
  source 1..20: mol_type = other DNA
tgtatggcatgagtaacgaa

SEQ ID NO: 9 - DNA, 79 bp, synthetic construct
  source 1..79: mol_type = other DNA
gttattgagaattattgtcatattattctaatattattaaggcttattcactgttattattataattattaagcttatt

SEQ ID NO: 10 - DNA, 74 bp, synthetic construct
  source 1..74: mol_type = other DNA
gttattgagaagttattatcatctattattaataagttattgccactattattgttataattattaagcttatt

SEQ ID NO: 11 - DNA, 68 bp, synthetic construct
  source 1..68: mol_type = other DNA
gttattgagaagtattattcatctaattattataaggccttattactgttattattaataagcttatt

SEQ ID NO: 12 - DNA, 63 bp, synthetic construct
  source 1..63: mol_type = other DNA
gttattgagaagtcttattatctaatattattaggccactgttattattataataagcttatt

SEQ ID NO: 13 - DNA, 64 bp, synthetic construct
  source 1..64: mol_type = other DNA
gttattgagaagtcattattatctaataagttattgccactgttattattataataagcttatt

SEQ ID NO: 14 - DNA, 62 bp, synthetic construct
  source 1..62: mol_type = other DNA
gatactttttattttttatatatatatatattttttatttttatatatatatatatagtatc

SEQ ID NO: 15 - DNA, 62 bp, synthetic construct
  source 1..62: mol_type = other DNA
gacactttttattttttatatatatatatattttttatttttatatatatatatatagtgtc

SEQ ID NO: 16 - DNA, 62 bp, synthetic construct
  source 1..62: mol_type = other DNA
gatactttttatttttgatatatatatatattttttatttttatatatatatatatcgtatc

SEQ ID NO: 17 - DNA, 62 bp, synthetic construct
  source 1..62: mol_type = other DNA
ggatctttttattttttatatatatatatattttttatttttatatatatatatatagatcc

SEQ ID NO: 18 - DNA, 62 bp, synthetic construct
  source 1..62: mol_type = other DNA
gacactttttatttttgatatatatatatattttttatttttatatatatatatatcgtgtc

SEQ ID NO: 19 - DNA, 62 bp, synthetic construct
  source 1..62: mol_type = other DNA
ggatctttttatttttgatatatatatatattttttatttttatatatatatatatcgatcc

SEQ ID NO: 20 - DNA, 62 bp, synthetic construct
  source 1..62: mol_type = other DNA
gcgtctttttattttttatatatatatatattttttatttttatatatatatatatagacgc

SEQ ID NO: 21 - DNA, 62 bp, synthetic construct
  source 1..62: mol_type = other DNA
gcgtctttttatttttgatatatatatatattttttatttttatatatatatatatcgacgc

SEQ ID NO: 22 - DNA, 62 bp, synthetic construct
  source 1..62: mol_type = other DNA
gtatactttttattttttatatatatatatatttttattttttatatatatatatagtatac

SEQ ID NO: 23 - DNA, 62 bp, synthetic construct
  source 1..62: mol_type = other DNA
gtgatctttttattttttatatatatatatatttttattttttatatatatatatagatcac

SEQ ID NO: 24 - DNA, 62 bp, synthetic construct
  source 1..62: mol_type = other DNA
gtatactttttatttttgatatatatatatatttttattttttatatatatatatcgtatac

SEQ ID NO: 25 - DNA, 62 bp, synthetic construct
  source 1..62: mol_type = other DNA
gtatactttttatttttgatatatgtatatatttttattttttatatacatatatcgtatac

SEQ ID NO: 26 - DNA, 62 bp, synthetic construct
  source 1..62: mol_type = other DNA
ggatactttttattttttatatatatatatatttttattttttatatatatatatagtatcc

SEQ ID NO: 27 - DNA, 62 bp, synthetic construct
  source 1..62: mol_type = other DNA
gtgatctttttatttttgatatatatatatatttttattttttatatatatatatcgatcac

SEQ ID NO: 28 - DNA, 62 bp, synthetic construct
  source 1..62: mol_type = other DNA
gtgatctttttatttttgatatatgtatatatttttattttttatatacatatatcgatcac

SEQ ID NO: 29 - DNA, 62 bp, synthetic construct
  source 1..62: mol_type = other DNA
ggatactttttatttttgatatatatatatatttttattttttatatatatatatcgtatcc

SEQ ID NO: 30 - DNA, 62 bp, synthetic construct
  source 1..62: mol_type = other DNA
ggatactttttatttttgatatatgtatatatttttattttttatatacatatatcgtatcc

SEQ ID NO: 31 - DNA, 62 bp, synthetic construct
  source 1..62: mol_type = other DNA
gcgatctttttattttttatatatatatatatttttattttttatatatatatatagatcgc

SEQ ID NO: 32 - DNA, 62 bp, synthetic construct
  source 1..62: mol_type = other DNA
gcgatctttttatttttgatatatatatatatttttattttttatatatatatatcgatcgc

SEQ ID NO: 33 - DNA, 62 bp, synthetic construct
  source 1..62: mol_type = other DNA
gcgatctttttatttttgatatatgtatatatttttattttttatatacatatatcgatcgc

SEQ ID NO: 34 - DNA, 62 bp, synthetic construct
  source 1..62: mol_type = other DNA
gatatactttttattttttatatatatatattttttatttttatatatatatatagtatatc

SEQ ID NO: 35 - DNA, 62 bp, synthetic construct
  source 1..62: mol_type = other DNA
gatatattttttatttttgatatatatatattttttatttttatatatatatatcatatatc

SEQ ID NO: 36 - DNA, 62 bp, synthetic construct
  source 1..62: mol_type = other DNA
gatatattttttatttttgatatatgtatattttttatttttatatacatatatcatatatc

SEQ ID NO: 37 - DNA, 62 bp, synthetic construct
  source 1..62: mol_type = other DNA
gtgatactttttattttttatatatatatattttttatttttatatatatatatagtatcac

SEQ ID NO: 38 - DNA, 62 bp, synthetic construct
  source 1..62: mol_type = other DNA
gatatactttttatttttgatatatatatattttttatttttatatatatatatcgtatatc

SEQ ID NO: 39 - DNA, 62 bp, synthetic construct
  source 1..62: mol_type = other DNA
gatatactttttatttttgatatatgtatattttttatttttatatacatatatcgtatatc

SEQ ID NO: 40 - DNA, 62 bp, synthetic construct
  source 1..62: mol_type = other DNA
ggtatactttttattttttatatatatatattttttatttttatatatatatatagtatacc

SEQ ID NO: 41 - DNA, 62 bp, synthetic construct
  source 1..62: mol_type = other DNA
gtgatactttttatttttgatatatatatattttttatttttatatatatatatcgtatcac

SEQ ID NO: 42 - DNA, 62 bp, synthetic construct
  source 1..62: mol_type = other DNA
gtgatactttttatttttgatatatgtatattttttatttttatatacatatatcgtatcac

SEQ ID NO: 43 - DNA, 62 bp, synthetic construct
  source 1..62: mol_type = other DNA
ggtatactttttatttttgatatatatatattttttatttttatatatatatatcgtatacc

SEQ ID NO: 44 - DNA, 62 bp, synthetic construct
  source 1..62: mol_type = other DNA
ggtatactttttatttttgatatatgtatattttttatttttatatacatatatcgtatacc

SEQ ID NO: 45 - DNA, 62 bp, synthetic construct
  source 1..62: mol_type = other DNA
ggtgtactttttattttttatatatatatattttttatttttatatatatatatagtacacc

SEQ ID NO: 46 - DNA, 62 bp, synthetic construct
  source 1..62: mol_type = other DNA
ggtgtactttttatttttgatatatatatattttttatttttatatatatatatcgtacacc

SEQ ID NO: 47 - DNA, 62 bp, synthetic construct
  source 1..62: mol_type = other DNA
ggtgtactttttatttttgatatatgtatattttttatttttatatacatatatcgtacacc

SEQ ID NO: 48 - DNA, 62 bp, synthetic construct
  source 1..62: mol_type = other DNA
gtatatactttttattttttatatatatatatttttattttttatatatatatagtatatac

SEQ ID NO: 49 - DNA, 62 bp, synthetic construct
  source 1..62: mol_type = other DNA
gtatatactttttatttttgatatatatatatttttattttttatatatatatcgtatatac

SEQ ID NO: 50 - DNA, 62 bp, synthetic construct
  source 1..62: mol_type = other DNA
gtatatactttttatttttgatatatgtatatttttattttttatacatatatcgtatatac

SEQ ID NO: 51 - DNA, 62 bp, synthetic construct
  source 1..62: mol_type = other DNA
gtatatactttttatttttgatcatgtatattttttatttttatatacatgatcgtatatac

SEQ ID NO: 52 - DNA, 62 bp, synthetic construct
  source 1..62: mol_type = other DNA
gtatatactttttatttttgatcatatatgttttttatttttacatatatgatcgtatatac

SEQ ID NO: 53 - DNA, 62 bp, synthetic construct
  source 1..62: mol_type = other DNA
ggatatactttttattttttatatatatatatttttattttttatatatatatagtatatcc

SEQ ID NO: 54 - DNA, 62 bp, synthetic construct
  source 1..62: mol_type = other DNA
ggatatactttttatttttgatatatatatatttttattttttatatatatatcgtatatcc

SEQ ID NO: 55 - DNA, 62 bp, synthetic construct
  source 1..62: mol_type = other DNA
ggatatactttttatttttgatatatgtatatttttattttttatacatatatcgtatatcc

SEQ ID NO: 56 - DNA, 62 bp, synthetic construct
  source 1..62: mol_type = other DNA
ggatatactttttatttttgatcatgtatattttttatttttatatacatgatcgtatatcc

SEQ ID NO: 57 - DNA, 62 bp, synthetic construct
  source 1..62: mol_type = other DNA
ggatatactttttatttttgatcatatatgttttttatttttacatatatgatcgtatatcc

SEQ ID NO: 58 - DNA, 62 bp, synthetic construct
  source 1..62: mol_type = other DNA
ggtgatactttttattttttatatatatatatttttattttttatatatatatagtatcacc

SEQ ID NO: 59 - DNA, 62 bp, synthetic construct
  source 1..62: mol_type = other DNA
ggtgatactttttatttttgatatatatatatttttattttttatatatatatcgtatcacc

SEQ ID NO: 60 - DNA, 62 bp, synthetic construct
  source 1..62: mol_type = other DNA
ggtgatactttttatttttgatatatgtatatttttattttttatacatatatcgtatcacc

SEQ ID NO: 61 - DNA, 62 bp, synthetic construct
  source 1..62: mol_type = other DNA
ggtgatactttttatttttgatcatgtatattttttatttttatatacatgatcgtatcacc

SEQ ID NO: 62 - DNA, 62 bp, synthetic construct
  source 1..62: mol_type = other DNA
ggtgatactttttatttttgatcatatatgttttttatttttacatatatgatcgtatcacc

SEQ ID NO: 63 - DNA, 62 bp, synthetic construct
  source 1..62: mol_type = other DNA
ggtgatcctttttattttttatatatatatatttttattttttatatatatataggatcacc

SEQ ID NO: 64 - DNA, 62 bp, synthetic construct
  source 1..62: mol_type = other DNA
ggtgatcctttttatttttgatatatatatatttttattttttatatatatatcggatcacc

SEQ ID NO: 65 - DNA, 62 bp, synthetic construct
  source 1..62: mol_type = other DNA
ggtgatcctttttatttttgatatatgtatatttttattttttatacatatatcggatcacc

SEQ ID NO: 66 - DNA, 62 bp, synthetic construct
  source 1..62: mol_type = other DNA
ggtgatcctttttatttttgatcatgtatattttttatttttatatacatgatcggatcacc

SEQ ID NO: 67 - DNA, 62 bp, synthetic construct
  source 1..62: mol_type = other DNA
ggtgatcctttttatttttgatcatatatgttttttatttttacatatatgatcggatcacc

SEQ ID NO: 68 - DNA, 62 bp, synthetic construct
  source 1..62: mol_type = other DNA
gatatatcactttttattttttatatatatatttttattttttatatatatagtgatatatc

SEQ ID NO: 69 - DNA, 62 bp, synthetic construct
  source 1..62: mol_type = other DNA
gtatatacattttttatttttgatatatatatttttattttttatatatatcatgtatatac

SEQ ID NO: 70 - DNA, 62 bp, synthetic construct
  source 1..62: mol_type = other DNA
gtatatacattttttatttttgatatatgtatttttattttttacatatatcatgtatatac

SEQ ID NO: 71 - DNA, 62 bp, synthetic construct
  source 1..62: mol_type = other DNA
gtatatacattttttatttttgatcatgtattttttatttttatacatgatcatgtatatac

SEQ ID NO: 72 - DNA, 62 bp, synthetic construct
  source 1..62: mol_type = other DNA
gtatatacattttttatttttgatcatatattttttatttttatatatgatcatgtatatac

SEQ ID NO: 73 - DNA, 62 bp, synthetic construct
  source 1..62: mol_type = other DNA
ggatatacactttttattttttatatatatatttttattttttatatatatagtgtatatcc

SEQ ID NO: 74 - DNA, 62 bp, synthetic construct
  source 1..62: mol_type = other DNA
ggatatacattttttatttttgatatatatatttttattttttatatatatcatgtatatcc

SEQ ID NO: 75 - DNA, 62 bp, synthetic construct
  source 1..62: mol_type = other DNA
ggatatacattttttatttttgatatatgtatttttattttttacatatatcatgtatatcc

SEQ ID NO: 76 - DNA, 62 bp, synthetic construct
  source 1..62: mol_type = other DNA
ggatatacattttttatttttgatcatgtattttttatttttatacatgatcatgtatatcc

SEQ ID NO: 77 - DNA, 62 bp, synthetic construct
  source 1..62: mol_type = other DNA
ggatatacattttttatttttgatcatatattttttatttttatatatgatcatgtatatcc

SEQ ID NO: 78 - DNA, 62 bp, synthetic construct
  source 1..62: mol_type = other DNA
gggtatatactttttattttttatatatatatttttattttttatatatatagtatataccc

SEQ ID NO: 79 - DNA, 62 bp, synthetic construct
  source 1..62: mol_type = other DNA
ggatatacactttttatttttgatatatatatttttattttttatatatatcgtgtatatcc

SEQ ID NO: 80 - DNA, 62 bp, synthetic construct
  source 1..62: mol_type = other DNA
ggatatacactttttatttttgatatatgtatttttattttttacatatatcgtgtatatcc

SEQ ID NO: 81 - DNA, 62 bp, synthetic construct
  source 1..62: mol_type = other DNA
ggatatacactttttatttttgatcatgtattttttatttttatacatgatcgtgtatatcc

SEQ ID NO: 82 - DNA, 62 bp, synthetic construct
  source 1..62: mol_type = other DNA
ggatatacactttttatttttgatcatatattttttatttttatatatgatcgtgtatatcc

SEQ ID NO: 83 - DNA, 62 bp, synthetic construct
  source 1..62: mol_type = other DNA
gggtatatactttttatttttgatatatatatttttattttttatatatatcgtatataccc

SEQ ID NO: 84 - DNA, 62 bp, synthetic construct
  source 1..62: mol_type = other DNA
gggtatatactttttatttttgatatatgtatttttattttttacatatatcgtatataccc

SEQ ID NO: 85 - DNA, 62 bp, synthetic construct
  source 1..62: mol_type = other DNA
gggtatatactttttatttttgatcatgtattttttatttttatacatgatcgtatataccc

SEQ ID NO: 86 - DNA, 62 bp, synthetic construct
  source 1..62: mol_type = other DNA
gggtatatactttttatttttgatcatatattttttatttttatatatgatcgtatataccc

SEQ ID NO: 87 - DNA, 62 bp, synthetic construct
  source 1..62: mol_type = other DNA
ggatgtacactttttattttttatatatatatttttattttttatatatatagtgtacatcc

SEQ ID NO: 88 - DNA, 62 bp, synthetic construct
  source 1..62: mol_type = other DNA
ggatgtacactttttatttttgatatatatatttttattttttatatatatcgtgtacatcc

SEQ ID NO: 89 - DNA, 62 bp, synthetic construct
  source 1..62: mol_type = other DNA
ggatgtacactttttatttttgatatatgtatttttattttttacatatatcgtgtacatcc

SEQ ID NO: 90 - DNA, 62 bp, synthetic construct
  source 1..62: mol_type = other DNA
ggatgtacactttttatttttgatcatgtattttttatttttatacatgatcgtgtacatcc

SEQ ID NO: 91 - DNA, 62 bp, synthetic construct
  source 1..62: mol_type = other DNA
ggatgtacactttttatttttgatcatatattttttatttttatatatgatcgtgtacatcc

SEQ ID NO: 92 - DNA, 68 bp, synthetic construct
  source 1..68: mol_type = other DNA
gtatatactttttattttttatatatatatatattttttatttttatatatatatatatagtatatac

SEQ ID NO: 93 - DNA, 68 bp, synthetic construct
  source 1..68: mol_type = other DNA
gtatatactttttatttttgatatatatatatattttttatttttatatatatatatatcgtatatac

SEQ ID NO: 94 - DNA, 68 bp, synthetic construct
  source 1..68: mol_type = other DNA
ggatatactttttattttttatatatatatatattttttatttttatatatatatatatagtatatcc

SEQ ID NO: 95 - DNA, 68 bp, synthetic construct
  source 1..68: mol_type = other DNA
ggatatactttttatttttgatatatatatatattttttatttttatatatatatatatcgtatatcc

SEQ ID NO: 96 - DNA, 68 bp, synthetic construct
  source 1..68: mol_type = other DNA
ggtgatactttttattttttatatatatatatattttttatttttatatatatatatatagtatcacc

SEQ ID NO: 97 - DNA, 68 bp, synthetic construct
  source 1..68: mol_type = other DNA
ggtgatactttttatttttgatatatatatatattttttatttttatatatatatatatcgtatcacc

SEQ ID NO: 98 - DNA, 68 bp, synthetic construct
  source 1..68: mol_type = other DNA
ggtgatcctttttattttttatatatatatatattttttatttttatatatatatatataggatcacc

SEQ ID NO: 99 - DNA, 68 bp, synthetic construct
  source 1..68: mol_type = other DNA
ggtgatcctttttatttttgatatatatatatattttttatttttatatatatatatatcggatcacc

SEQ ID NO: 100 - DNA, 72 bp, synthetic construct
  source 1..72: mol_type = other DNA
gatatatcactttttattttttatatatatatatattttttatttttatatatatatatatagtgatatatc

SEQ ID NO: 101 - DNA, 72 bp, synthetic construct
  source 1..72: mol_type = other DNA
gtatatacattttttatttttgatatatatatatattttttatttttatatatatatatatcatgtatatac

SEQ ID NO: 102 - DNA, 72 bp, synthetic construct
  source 1..72: mol_type = other DNA
ggatatacactttttattttttatatatatatatattttttatttttatatatatatatatagtgtatatcc

SEQ ID NO: 103 - DNA, 72 bp, synthetic construct
  source 1..72: mol_type = other DNA
ggatatacattttttatttttgatatatatatatattttttatttttatatatatatatatcatgtatatcc

SEQ ID NO: 104 - DNA, 72 bp, synthetic construct
  source 1..72: mol_type = other DNA
gggtatatactttttattttttatatatatatatattttttatttttatatatatatatatagtatataccc

SEQ ID NO: 105 - DNA, 72 bp, synthetic construct
  source 1..72: mol_type = other DNA
ggatatacactttttatttttgatatatatatatattttttatttttatatatatatatatcgtgtatatcc

SEQ ID NO: 106 - DNA, 72 bp, synthetic construct
  source 1..72: mol_type = other DNA
gggtatatactttttatttttgatatatatatatattttttatttttatatatatatatatcgtatataccc

SEQ ID NO: 107 - DNA, 66 bp, synthetic construct
  source 1..66: mol_type = other DNA
gtatatactttttattttttatatatatatatatttttattttttatatatatatatagtatatac

SEQ ID NO: 108 - DNA, 66 bp, synthetic construct
  source 1..66: mol_type = other DNA
gtatatactttttatttttgatatatatatatatttttattttttatatatatatatcgtatatac

SEQ ID NO: 109 - DNA, 66 bp, synthetic construct
  source 1..66: mol_type = other DNA
gtatatactttttatttttgatatatgtatatatttttattttttatatacatatatcgtatatac

SEQ ID NO: 110 - DNA, 66 bp, synthetic construct
  source 1..66: mol_type = other DNA
ggatatactttttattttttatatatatatatatttttattttttatatatatatatagtatatcc

SEQ ID NO: 111 - DNA, 66 bp, synthetic construct
  source 1..66: mol_type = other DNA
ggatatactttttatttttgatatatatatatatttttattttttatatatatatatcgtatatcc

SEQ ID NO: 112 - DNA, 66 bp, synthetic construct
  source 1..66: mol_type = other DNA
ggatatactttttatttttgatatatgtatatatttttattttttatatacatatatcgtatatcc

SEQ ID NO: 113 - DNA, 66 bp, synthetic construct
  source 1..66: mol_type = other DNA
ggtgatactttttattttttatatatatatatatttttattttttatatatatatatagtatcacc

SEQ ID NO: 114 - DNA, 66 bp, synthetic construct
  source 1..66: mol_type = other DNA
ggtgatactttttatttttgatatatatatatatttttattttttatatatatatatcgtatcacc

SEQ ID NO: 115 - DNA, 66 bp, synthetic construct
  source 1..66: mol_type = other DNA
ggtgatactttttatttttgatatatgtatatatttttattttttatatacatatatcgtatcacc

SEQ ID NO: 116 - DNA, 66 bp, synthetic construct
  source 1..66: mol_type = other DNA
ggtgatcctttttattttttatatatatatatatttttattttttatatatatatataggatcacc

SEQ ID NO: 117 - DNA, 66 bp, synthetic construct
  source 1..66: mol_type = other DNA
ggtgatcctttttatttttgatatatatatatatttttattttttatatatatatatcggatcacc

SEQ ID NO: 118 - DNA, 66 bp, synthetic construct
  source 1..66: mol_type = other DNA
ggtgatcctttttatttttgatatatgtatatatttttattttttatatacatatatcggatcacc

SEQ ID NO: 119 - DNA, 70 bp, synthetic construct
  source 1..70: mol_type = other DNA
gatatatcactttttattttttatatatatatatatttttattttttatatatatatatagtgatatatc

SEQ ID NO: 120 - DNA, 70 bp, synthetic construct
  source 1..70: mol_type = other DNA
gtatatacattttttatttttgatatatatatatatttttattttttatatatatatatcatgtatatac

SEQ ID NO: 121 - DNA, 70 bp, synthetic construct
  source 1..70: mol_type = other DNA
gtatatacattttttatttttgatatatgtatatatttttattttttatatacatatatcatgtatatac

SEQ ID NO: 122 - DNA, 70 bp, synthetic construct
  source 1..70: mol_type = other DNA
ggatatacactttttattttttatatatatatatatttttattttttatatatatatatagtgtatatcc

SEQ ID NO: 123 - DNA, 70 bp, synthetic construct
  source 1..70: mol_type = other DNA
ggatatacattttttatttttgatatatatatatatttttattttttatatatatatatcatgtatatcc

SEQ ID NO: 124 - DNA, 70 bp, synthetic construct
  source 1..70: mol_type = other DNA
ggatatacattttttatttttgatatatgtatatatttttattttttatatacatatatcatgtatatcc

SEQ ID NO: 125 - DNA, 70 bp, synthetic construct
  source 1..70: mol_type = other DNA
gggtatatactttttattttttatatatatatatatttttattttttatatatatatatagtatataccc

SEQ ID NO: 126 - DNA, 70 bp, synthetic construct
  source 1..70: mol_type = other DNA
ggatatacactttttatttttgatatatatatatatttttattttttatatatatatatcgtgtatatcc

SEQ ID NO: 127 - DNA, 70 bp, synthetic construct
  source 1..70: mol_type = other DNA
ggatatacactttttatttttgatatatgtatatatttttattttttatatacatatatcgtgtatatcc

SEQ ID NO: 128 - DNA, 70 bp, synthetic construct
  source 1..70: mol_type = other DNA
gggtatatactttttatttttgatatatatatatatttttattttttatatatatatatcgtatataccc

SEQ ID NO: 129 - DNA, 70 bp, synthetic construct
  source 1..70: mol_type = other DNA
gggtatatactttttatttttgatatatgtatatatttttattttttatatacatatatcgtatataccc

SEQ ID NO: 130 - DNA, 68 bp, synthetic construct
  source 1..68: mol_type = other DNA
gatatatcactttttattttttatatatatatattttttatttttatatatatatatagtgatatatc

SEQ ID NO: 131 - DNA, 68 bp, synthetic construct
  source 1..68: mol_type = other DNA
gtatatacattttttatttttgatatatatatattttttatttttatatatatatatcatgtatatac

SEQ ID NO: 132 - DNA, 68 bp, synthetic construct
  source 1..68: mol_type = other DNA
gtatatacattttttatttttgatatatgtatattttttatttttatatacatatatcatgtatatac

SEQ ID NO: 133 - DNA, 68 bp, synthetic construct
  source 1..68: mol_type = other DNA
ggatatacactttttattttttatatatatatattttttatttttatatatatatatagtgtatatcc

SEQ ID NO: 134 - DNA, 68 bp, synthetic construct
  source 1..68: mol_type = other DNA
ggatatacattttttatttttgatatatatatattttttatttttatatatatatatcatgtatatcc

SEQ ID NO: 135 - DNA, 68 bp, synthetic construct
  source 1..68: mol_type = other DNA
ggatatacattttttatttttgatatatgtatattttttatttttatatacatatatcatgtatatcc

SEQ ID NO: 136 - DNA, 68 bp, synthetic construct
  source 1..68: mol_type = other DNA
gggtatatactttttattttttatatatatatattttttatttttatatatatatatagtatataccc

SEQ ID NO: 137 - DNA, 68 bp, synthetic construct
  source 1..68: mol_type = other DNA
ggatatacactttttatttttgatatatatatattttttatttttatatatatatatcgtgtatatcc

SEQ ID NO: 138 - DNA, 68 bp, synthetic construct
  source 1..68: mol_type = other DNA
ggatatacactttttatttttgatatatgtatattttttatttttatatacatatatcgtgtatatcc

SEQ ID NO: 139 - DNA, 68 bp, synthetic construct
  source 1..68: mol_type = other DNA
gggtatatactttttatttttgatatatatatattttttatttttatatatatatatcgtatataccc

SEQ ID NO: 140 - DNA, 68 bp, synthetic construct
  source 1..68: mol_type = other DNA
gggtatatactttttatttttgatatatgtatattttttatttttatatacatatatcgtatataccc

SEQ ID NO: 141 - DNA, 66 bp, synthetic construct
  source 1..66: mol_type = other DNA
gatatatcactttttattttttatatatatatatttttattttttatatatatatagtgatatatc

SEQ ID NO: 142 - DNA, 66 bp, synthetic construct
  source 1..66: mol_type = other DNA
gtatatacattttttatttttgatatatatatatttttattttttatatatatatcatgtatatac

SEQ ID NO: 143 - DNA, 66 bp, synthetic construct
  source 1..66: mol_type = other DNA
gtatatacattttttatttttgatatatgtatatttttattttttatacatatatcatgtatatac

SEQ ID NO: 144 - DNA, 66 bp, synthetic construct
  source 1..66: mol_type = other DNA
gtatatacattttttatttttgatcatgtatattttttatttttatatacatgatcatgtatatac

SEQ ID NO: 145 - DNA, 66 bp, synthetic construct
  source 1..66: mol_type = other DNA
gtatatacattttttatttttgatcatatatgttttttatttttacatatatgatcatgtatatac

SEQ ID NO: 146 - DNA, 66 bp, synthetic construct
  source 1..66: mol_type = other DNA
ggatatacactttttattttttatatatatatatttttattttttatatatatatagtgtatatcc

SEQ ID NO: 147 - DNA, 66 bp, synthetic construct
  source 1..66: mol_type = other DNA
ggatatacattttttatttttgatatatatatatttttattttttatatatatatcatgtatatcc

SEQ ID NO: 148 - DNA, 66 bp, synthetic construct
  source 1..66: mol_type = other DNA
ggatatacattttttatttttgatatatgtatatttttattttttatacatatatcatgtatatcc

SEQ ID NO: 149 - DNA, 66 bp, synthetic construct
  source 1..66: mol_type = other DNA
ggatatacattttttatttttgatcatgtatattttttatttttatatacatgatcatgtatatcc

SEQ ID NO: 150 - DNA, 66 bp, synthetic construct
  source 1..66: mol_type = other DNA
ggatatacattttttatttttgatcatatatgttttttatttttacatatatgatcatgtatatcc

SEQ ID NO: 151 - DNA, 66 bp, synthetic construct
  source 1..66: mol_type = other DNA
gggtatatactttttattttttatatatatatatttttattttttatatatatatagtatataccc

SEQ ID NO: 152 - DNA, 66 bp, synthetic construct
  source 1..66: mol_type = other DNA
ggatatacactttttatttttgatatatatatatttttattttttatatatatatcgtgtatatcc

SEQ ID NO: 153 - DNA, 66 bp, synthetic construct
  source 1..66: mol_type = other DNA
ggatatacactttttatttttgatatatgtatatttttattttttatacatatatcgtgtatatcc

SEQ ID NO: 154 - DNA, 66 bp, synthetic construct
  source 1..66: mol_type = other DNA
ggatatacactttttatttttgatcatgtatattttttatttttatatacatgatcgtgtatatcc

SEQ ID NO: 155 - DNA, 66 bp, synthetic construct
  source 1..66: mol_type = other DNA
ggatatacactttttatttttgatcatatatgttttttatttttacatatatgatcgtgtatatcc

SEQ ID NO: 156 - DNA, 66 bp, synthetic construct
  source 1..66: mol_type = other DNA
gggtatatactttttatttttgatatatatatatttttattttttatatatatatcgtatataccc

SEQ ID NO: 157 - DNA, 66 bp, synthetic construct
  source 1..66: mol_type = other DNA
gggtatatactttttatttttgatatatgtatatttttattttttatacatatatcgtatataccc

SEQ ID NO: 158 - DNA, 66 bp, synthetic construct
  source 1..66: mol_type = other DNA
gggtatatactttttatttttgatcatgtatattttttatttttatatacatgatcgtatataccc

SEQ ID NO: 159 - DNA, 66 bp, synthetic construct
  source 1..66: mol_type = other DNA
gggtatatactttttatttttgatcatatatgttttttatttttacatatatgatcgtatataccc

SEQ ID NO: 160 - DNA, 64 bp, synthetic construct
  source 1..64: mol_type = other DNA
gtacatatatttttttatttttgatatatatatttttattttttatatatatcaatatatgtac

SEQ ID NO: 161 - DNA, 64 bp, synthetic construct
  source 1..64: mol_type = other DNA
gtacatatatttttttatttttgatatatgtatttttattttttacatatatcaatatatgtac

SEQ ID NO: 162 - DNA, 64 bp, synthetic construct
  source 1..64: mol_type = other DNA
gtacatatatttttttatttttgatcatgtattttttatttttatacatgatcaatatatgtac

SEQ ID NO: 163 - DNA, 64 bp, synthetic construct
  source 1..64: mol_type = other DNA
gtacatatatttttttatttttgatcatatattttttatttttatatatgatcaatatatgtac

SEQ ID NO: 164 - DNA, 64 bp, synthetic construct
  source 1..64: mol_type = other DNA
gatgtatatactttttattttttatatatatatttttattttttatatatatagtatatacatc

SEQ ID NO: 165 - DNA, 64 bp, synthetic construct
  source 1..64: mol_type = other DNA
ggtacatatattttttatttttgatatatatatttttattttttatatatatcatatatgtacc

SEQ ID NO: 166 - DNA, 64 bp, synthetic construct
  source 1..64: mol_type = other DNA
ggtacatatattttttatttttgatatatgtatttttattttttacatatatcatatatgtacc

SEQ ID NO: 167 - DNA, 64 bp, synthetic construct
  source 1..64: mol_type = other DNA
ggtacatatattttttatttttgatcatgtattttttatttttatacatgatcatatatgtacc

SEQ ID NO: 168 - DNA, 64 bp, synthetic construct
  source 1..64: mol_type = other DNA
ggtacatatattttttatttttgatcatatattttttatttttatatatgatcatatatgtacc

SEQ ID NO: 169 - DNA, 66 bp, synthetic construct
  source 1..66: mol_type = other DNA
cgatcatatatttttttatttttgatatatatatttttattttttatatatatcaatatatgatcg

SEQ ID NO: 170 - DNA, 66 bp, synthetic construct
  source 1..66: mol_type = other DNA
cgatcatatatttttttatttttgatatatgtatttttattttttacatatatcaatatatgatcg

SEQ ID NO: 171 - DNA, 66 bp, synthetic construct
  source 1..66: mol_type = other DNA
cgatcatatatttttttatttttgatcatgtattttttatttttatacatgatcaatatatgatcg

SEQ ID NO: 172 - DNA, 66 bp, synthetic construct
  source 1..66: mol_type = other DNA
cgatcatatatttttttatttttgatcatatattttttatttttatatatgatcaatatatgatcg

SEQ ID NO: 173 - DNA, 62 bp, synthetic construct
  source 1..62: mol_type = other DNA
gatactttttattttttataaatatatatattttttatttttatatatatatatatagtatc

SEQ ID NO: 174 - DNA, 62 bp, synthetic construct
  source 1..62: mol_type = other DNA
gacactttttattttttataaatatatatattttttatttttatatatatatatatagtgtc

SEQ ID NO: 175 - DNA, 62 bp, synthetic construct
  source 1..62: mol_type = other DNA
gatactttttatttttgataaatatatatattttttatttttatatatatatatatcgtatc

SEQ ID NO: 176 - DNA, 62 bp, synthetic construct
  source 1..62: mol_type = other DNA
gatactttttatttttgataaatgtatatattttttatttttatatatacatatatcgtatc

SEQ ID NO: 177 - DNA, 62 bp, synthetic construct
  source 1..62: mol_type = other DNA
gatactttttatttttgatgatgtatatatatttttattttttatatatacatgatcgtatc

SEQ ID NO: 178 - DNA, 62 bp, synthetic construct
  source 1..62: mol_type = other DNA
gatactttttatttttgatgatatatgtacttttttatttttagtacatatatgatcgtatc

SEQ ID NO: 179 - DNA, 62 bp, synthetic construct
  source 1..62: mol_type = other DNA
ggatctttttattttttataaatatatatattttttatttttatatatatatatatagatcc

SEQ ID NO: 180 - DNA, 62 bp, synthetic construct
  source 1..62: mol_type = other DNA
gacactttttatttttgataaatatatatattttttatttttatatatatatatatcgtgtc

SEQ ID NO: 181 - DNA, 62 bp, synthetic construct
  source 1..62: mol_type = other DNA
gacactttttatttttgataaatgtatatattttttatttttatatatacatatatcgtgtc

SEQ ID NO: 182 - DNA, 62 bp, synthetic construct
  source 1..62: mol_type = other DNA
gacactttttatttttgatgatgtatatatatttttattttttatatatacatgatcgtgtc

SEQ ID NO: 183 - DNA, 62 bp, synthetic construct
  source 1..62: mol_type = other DNA
gacactttttatttttgatgatatatgtacttttttatttttagtacatatatgatcgtgtc

SEQ ID NO: 184 - DNA, 62 bp, synthetic construct
  source 1..62: mol_type = other DNA
ggatctttttatttttgataaatatatatattttttatttttatatatatatatatcgatcc

SEQ ID NO: 185 - DNA, 62 bp, synthetic construct
  source 1..62: mol_type = other DNA
ggatctttttatttttgataaatgtatatattttttatttttatatatacatatatcgatcc

SEQ ID NO: 186 - DNA, 62 bp, synthetic construct
  source 1..62: mol_type = other DNA
ggatctttttatttttgatgatgtatatatatttttattttttatatatacatgatcgatcc

SEQ ID NO: 187 - DNA, 62 bp, synthetic construct
  source 1..62: mol_type = other DNA
ggatctttttatttttgatgatatatgtacttttttatttttagtacatatatgatcgatcc

SEQ ID NO: 188 - DNA, 62 bp, synthetic construct
  source 1..62: mol_type = other DNA
gcgtctttttattttttataaatatatatattttttatttttatatatatatatatagacgc

SEQ ID NO: 189 - DNA, 62 bp, synthetic construct
  source 1..62: mol_type = other DNA
gcgtctttttatttttgataaatatatatattttttatttttatatatatatatatcgacgc

SEQ ID NO: 190 - DNA, 62 bp, synthetic construct
  source 1..62: mol_type = other DNA
gcgtctttttatttttgataaatgtatatattttttatttttatatatacatatatcgacgc

SEQ ID NO: 191 - DNA, 62 bp, synthetic construct
  source 1..62: mol_type = other DNA
gcgtctttttatttttgatgatgtatatatatttttattttttatatatacatgatcgacgc

SEQ ID NO: 192 - DNA, 62 bp, synthetic construct
  source 1..62: mol_type = other DNA
gcgtctttttatttttgatgatatatgtacttttttatttttagtacatatatgatcgacgc

SEQ ID NO: 193 - DNA, 62 bp, synthetic construct
  source 1..62: mol_type = other DNA
gtatactttttatttttgataaatatatatatttttattttttatatatatatatcgtatac

SEQ ID NO: 194 - DNA, 62 bp, synthetic construct
  source 1..62: mol_type = other DNA
gtatactttttatttttgataaatgtatatatttttattttttatatacatatatcgtatac

SEQ ID NO: 195 - DNA, 62 bp, synthetic construct
  source 1..62: mol_type = other DNA
gtatactttttatttttgatgatgtatatattttttatttttatatatacatgatcgtatac

SEQ ID NO: 196 - DNA, 62 bp, synthetic construct
  source 1..62: mol_type = other DNA
gtatactttttatttttgatgatatatgtactttttatttttgtacatatatgatcgtatac

SEQ ID NO: 197 - DNA, 62 bp, synthetic construct
  source 1..62: mol_type = other DNA
gtgatctttttatttttgataaatatatatatttttattttttatatatatatatcgatcac

SEQ ID NO: 198 - DNA, 62 bp, synthetic construct
  source 1..62: mol_type = other DNA
gtgatctttttatttttgataaatgtatatatttttattttttatatacatatatcgatcac

SEQ ID NO: 199 - DNA, 62 bp, synthetic construct
  source 1..62: mol_type = other DNA
gtgatctttttatttttgatgatgtatatattttttatttttatatatacatgatcgatcac

SEQ ID NO: 200 - DNA, 62 bp, synthetic construct
  source 1..62: mol_type = other DNA
gtgatctttttatttttgatgatatatgtactttttatttttgtacatatatgatcgatcac

SEQ ID NO: 201 - DNA, 62 bp, synthetic construct
  source 1..62: mol_type = other DNA
ggatactttttatttttgataaatatatatatttttattttttatatatatatatcgtatcc

SEQ ID NO: 202 - DNA, 62 bp, synthetic construct
  source 1..62: mol_type = other DNA
ggatactttttatttttgataaatgtatatatttttattttttatatacatatatcgtatcc

SEQ ID NO: 203 - DNA, 62 bp, synthetic construct
  source 1..62: mol_type = other DNA
ggatactttttatttttgatgatgtatatattttttatttttatatatacatgatcgtatcc

SEQ ID NO: 204 - DNA, 62 bp, synthetic construct
  source 1..62: mol_type = other DNA
ggatactttttatttttgatgatatatgtactttttatttttgtacatatatgatcgtatcc

SEQ ID NO: 205 - DNA, 62 bp, synthetic construct
  source 1..62: mol_type = other DNA
gcgatctttttatttttgataaatatatatatttttattttttatatatatatatcgatcgc

SEQ ID NO: 206 - DNA, 62 bp, synthetic construct
  source 1..62: mol_type = other DNA
gcgatctttttatttttgataaatgtatatatttttattttttatatacatatatcgatcgc

SEQ ID NO: 207 - DNA, 62 bp, synthetic construct
  source 1..62: mol_type = other DNA
gcgatctttttatttttgatgatgtatatattttttatttttatatatacatgatcgatcgc

SEQ ID NO: 208 - DNA, 62 bp, synthetic construct
  source 1..62: mol_type = other DNA
gcgatctttttatttttgatgatatatgtactttttatttttgtacatatatgatcgatcgc

SEQ ID NO: 209 - DNA, 62 bp, synthetic construct
  source 1..62: mol_type = other DNA
gatatactttttattttttataaatatatattttttatttttatatatatatatagtatatc

SEQ ID NO: 210 - DNA, 62 bp, synthetic construct
  source 1..62: mol_type = other DNA
gatatattttttatttttgataaatgtatattttttatttttatatacatatatcatatatc

SEQ ID NO: 211 - DNA, 62 bp, synthetic construct
  source 1..62: mol_type = other DNA
gatatattttttatttttgatgatgtatatatttttattttttatatacatgatcatatatc

SEQ ID NO: 212 - DNA, 62 bp, synthetic construct
  source 1..62: mol_type = other DNA
gatatattttttatttttgatgatatatgtatttttattttttacatatatgatcatatatc

SEQ ID NO: 213 - DNA, 62 bp, synthetic construct
  source 1..62: mol_type = other DNA
gtgatactttttattttttataaatatatattttttatttttatatatatatatagtatcac

SEQ ID NO: 214 - DNA, 62 bp, synthetic construct
  source 1..62: mol_type = other DNA
gatatactttttatttttgataaatatatattttttatttttatatatatatatcgtatatc

SEQ ID NO: 215 - DNA, 62 bp, synthetic construct
  source 1..62: mol_type = other DNA
gatatactttttatttttgatgatgtatatatttttattttttatatacatgatcgtatatc

SEQ ID NO: 216 - DNA, 62 bp, synthetic construct
  source 1..62: mol_type = other DNA
gatatactttttatttttgatgatatatgtatttttattttttacatatatgatcgtatatc

SEQ ID NO: 217 - DNA, 62 bp, synthetic construct
  source 1..62: mol_type = other DNA
ggtatactttttattttttataaatatatattttttatttttatatatatatatagtatacc

SEQ ID NO: 218 - DNA, 62 bp, synthetic construct
  source 1..62: mol_type = other DNA
gtgatactttttatttttgataaatatatattttttatttttatatatatatatcgtatcac

SEQ ID NO: 219 - DNA, 62 bp, synthetic construct
  source 1..62: mol_type = other DNA
gtgatactttttatttttgataaatgtatattttttatttttatatacatatatcgtatcac

SEQ ID NO: 220 - DNA, 62 bp, synthetic construct
  source 1..62: mol_type = other DNA
gtgatactttttatttttgatgatgtatatatttttattttttatatacatgatcgtatcac

SEQ ID NO: 221 - DNA, 62 bp, synthetic construct
  source 1..62: mol_type = other DNA
gtgatactttttatttttgatgatatatgtatttttattttttacatatatgatcgtatcac

SEQ ID NO: 222 - DNA, 62 bp, synthetic construct
  source 1..62: mol_type = other DNA
ggtatactttttatttttgataaatatatattttttatttttatatatatatatcgtatacc

SEQ ID NO: 223 - DNA, 62 bp, synthetic construct
  source 1..62: mol_type = other DNA
ggtatactttttatttttgataaatgtatattttttatttttatatacatatatcgtatacc

SEQ ID NO: 224 - DNA, 62 bp, synthetic construct
  source 1..62: mol_type = other DNA
ggtatactttttatttttgatgatgtatatatttttattttttatatacatgatcgtatacc

SEQ ID NO: 225 - DNA, 62 bp, synthetic construct
  source 1..62: mol_type = other DNA
ggtatactttttatttttgatgatatatgtatttttattttttacatatatgatcgtatacc

SEQ ID NO: 226 - DNA, 62 bp, synthetic construct
  source 1..62: mol_type = other DNA
ggtgtactttttattttttataaatatatattttttatttttatatatatatatagtacacc

SEQ ID NO: 227 - DNA, 62 bp, synthetic construct
  source 1..62: mol_type = other DNA
ggtgtactttttatttttgataaatatatattttttatttttatatatatatatcgtacacc

SEQ ID NO: 228 - DNA, 62 bp, synthetic construct
  source 1..62: mol_type = other DNA
ggtgtactttttatttttgataaatgtatattttttatttttatatacatatatcgtacacc

SEQ ID NO: 229 - DNA, 62 bp, synthetic construct
  source 1..62: mol_type = other DNA
ggtgtactttttatttttgatgatgtatatatttttattttttatatacatgatcgtacacc

SEQ ID NO: 230 - DNA, 62 bp, synthetic construct
  source 1..62: mol_type = other DNA
ggtgtactttttatttttgatgatatatgtatttttattttttacatatatgatcgtacacc

SEQ ID NO: 231 - DNA, 62 bp, synthetic construct
  source 1..62: mol_type = other DNA
gtatatactttttatttttgataaatatatatttttattttttatatatatatcgtatatac

SEQ ID NO: 232 - DNA, 62 bp, synthetic construct
  source 1..62: mol_type = other DNA
gtatatactttttatttttgataaatgtatatttttattttttatacatatatcgtatatac

SEQ ID NO: 233 - DNA, 62 bp, synthetic construct
  source 1..62: mol_type = other DNA
gtatatactttttatttttgatgatgtatattttttatttttatatacatgatcgtatatac

SEQ ID NO: 234 - DNA, 62 bp, synthetic construct
  source 1..62: mol_type = other DNA
gtatatactttttatttttgatgatatatgttttttatttttacatatatgatcgtatatac

SEQ ID NO: 235 - DNA, 62 bp, synthetic construct
  source 1..62: mol_type = other DNA
ggatatactttttatttttgataaatatatatttttattttttatatatatatcgtatatcc

SEQ ID NO: 236 - DNA, 62 bp, synthetic construct
  source 1..62: mol_type = other DNA
ggatatactttttatttttgataaatgtatatttttattttttatacatatatcgtatatcc

SEQ ID NO: 237 - DNA, 62 bp, synthetic construct
  source 1..62: mol_type = other DNA
ggatatactttttatttttgatgatgtatattttttatttttatatacatgatcgtatatcc

SEQ ID NO: 238 - DNA, 62 bp, synthetic construct
  source 1..62: mol_type = other DNA
ggatatactttttatttttgatgatatatgttttttatttttacatatatgatcgtatatcc

SEQ ID NO: 239 - DNA, 62 bp, synthetic construct
  source 1..62: mol_type = other DNA
ggtgatactttttatttttgataaatatatatttttattttttatatatatatcgtatcacc

SEQ ID NO: 240 - DNA, 62 bp, synthetic construct
  source 1..62: mol_type = other DNA
ggtgatactttttatttttgataaatgtatatttttattttttatacatatatcgtatcacc

SEQ ID NO: 241 - DNA, 62 bp, synthetic construct
  source 1..62: mol_type = other DNA
ggtgatactttttatttttgatgatgtatattttttatttttatatacatgatcgtatcacc

SEQ ID NO: 242 - DNA, 62 bp, synthetic construct
  source 1..62: mol_type = other DNA
ggtgatactttttatttttgatgatatatgttttttatttttacatatatgatcgtatcacc

SEQ ID NO: 243 - DNA, 62 bp, synthetic construct
  source 1..62: mol_type = other DNA
ggtgatcctttttatttttgataaatatatatttttattttttatatatatatcggatcacc

SEQ ID NO: 244 - DNA, 62 bp, synthetic construct
  source 1..62: mol_type = other DNA
ggtgatcctttttatttttgataaatgtatatttttattttttatacatatatcggatcacc

SEQ ID NO: 245 - DNA, 62 bp, synthetic construct
  source 1..62: mol_type = other DNA
ggtgatcctttttatttttgatgatgtatattttttatttttatatacatgatcggatcacc

SEQ ID NO: 246 - DNA, 62 bp, synthetic construct
  source 1..62: mol_type = other DNA
ggtgatcctttttatttttgatgatatatgttttttatttttacatatatgatcggatcacc

SEQ ID NO: 247 - DNA, 62 bp, synthetic construct
  source 1..62: mol_type = other DNA
gtatatacattttttatttttgataaatatatttttattttttatatatatcatgtatatac

SEQ ID NO: 248 - DNA, 62 bp, synthetic construct
  source 1..62: mol_type = other DNA
gtatatacattttttatttttgataaatgtatttttattttttacatatatcatgtatatac

SEQ ID NO: 249 - DNA, 62 bp, synthetic construct
  source 1..62: mol_type = other DNA
gtatatacattttttatttttgatgatgtattttttatttttatacatgatcatgtatatac

SEQ ID NO: 250 - DNA, 62 bp, synthetic construct
  source 1..62: mol_type = other DNA
gtatatacattttttatttttgatgatatattttttatttttatatatgatcatgtatatac

SEQ ID NO: 251 - DNA, 62 bp, synthetic construct
  source 1..62: mol_type = other DNA
ggatatacattttttatttttgataaatatatttttattttttatatatatcatgtatatcc

SEQ ID NO: 252 - DNA, 62 bp, synthetic construct
  source 1..62: mol_type = other DNA
ggatatacattttttatttttgataaatgtatttttattttttacatatatcatgtatatcc

SEQ ID NO: 253 - DNA, 62 bp, synthetic construct
  source 1..62: mol_type = other DNA
ggatatacattttttatttttgatgatgtattttttatttttatacatgatcatgtatatcc

SEQ ID NO: 254 - DNA, 62 bp, synthetic construct
  source 1..62: mol_type = other DNA
ggatatacattttttatttttgatgatatattttttatttttatatatgatcatgtatatcc

SEQ ID NO: 255 - DNA, 62 bp, synthetic construct
  source 1..62: mol_type = other DNA
ggatatacactttttatttttgataaatatatttttattttttatatatatcgtgtatatcc

SEQ ID NO: 256 - DNA, 62 bp, synthetic construct
  source 1..62: mol_type = other DNA
ggatatacactttttatttttgataaatgtatttttattttttacatatatcgtgtatatcc

SEQ ID NO: 257 - DNA, 62 bp, synthetic construct
  source 1..62: mol_type = other DNA
ggatatacactttttatttttgatgatgtattttttatttttatacatgatcgtgtatatcc

SEQ ID NO: 258 - DNA, 62 bp, synthetic construct
  source 1..62: mol_type = other DNA
ggatatacactttttatttttgatgatatattttttatttttatatatgatcgtgtatatcc

SEQ ID NO: 259 - DNA, 62 bp, synthetic construct
  source 1..62: mol_type = other DNA
gggtatatactttttatttttgataaatatatttttattttttatatatatcgtatataccc

SEQ ID NO: 260 - DNA, 62 bp, synthetic construct
  source 1..62: mol_type = other DNA
gggtatatactttttatttttgataaatgtatttttattttttacatatatcgtatataccc

SEQ ID NO: 261 - DNA, 62 bp, synthetic construct
  source 1..62: mol_type = other DNA
gggtatatactttttatttttgatgatgtattttttatttttatacatgatcgtatataccc

SEQ ID NO: 262 - DNA, 62 bp, synthetic construct
  source 1..62: mol_type = other DNA
gggtatatactttttatttttgatgatatattttttatttttatatatgatcgtatataccc

SEQ ID NO: 263 - DNA, 62 bp, synthetic construct
  source 1..62: mol_type = other DNA
ggatgtacactttttatttttgataaatatatttttattttttatatatatcgtgtacatcc

SEQ ID NO: 264 - DNA, 62 bp, synthetic construct
  source 1..62: mol_type = other DNA
ggatgtacactttttatttttgataaatgtatttttattttttacatatatcgtgtacatcc

SEQ ID NO: 265 - DNA, 62 bp, synthetic construct
  source 1..62: mol_type = other DNA
ggatgtacactttttatttttgatgatgtattttttatttttatacatgatcgtgtacatcc

SEQ ID NO: 266 - DNA, 62 bp, synthetic construct
  source 1..62: mol_type = other DNA
ggatgtacactttttatttttgatgatatattttttatttttatatatgatcgtgtacatcc

SEQ ID NO: 267 - DNA, 68 bp, synthetic construct
  source 1..68: mol_type = other DNA
gtatatactttttattttttataaatatatatattttttatttttatatatatatatatagtatatac

SEQ ID NO: 268 - DNA, 68 bp, synthetic construct
  source 1..68: mol_type = other DNA
gtatatactttttatttttgataaatatatatattttttatttttatatatatatatatcgtatatac

SEQ ID NO: 269 - DNA, 68 bp, synthetic construct
  source 1..68: mol_type = other DNA
gtatatactttttatttttgataaatgtatatattttttatttttatatatacatatatcgtatatac

SEQ ID NO: 270 - DNA, 68 bp, synthetic construct
  source 1..68: mol_type = other DNA
gtatatactttttatttttgatgatgtatatatatttttattttttatatatacatgatcgtatatac

SEQ ID NO: 271 - DNA, 68 bp, synthetic construct
  source 1..68: mol_type = other DNA
gtatatactttttatttttgatgatatatgtacttttttatttttagtacatatatgatcgtatatac

SEQ ID NO: 272 - DNA, 68 bp, synthetic construct
  source 1..68: mol_type = other DNA
ggatatactttttattttttataaatatatatattttttatttttatatatatatatatagtatatcc

SEQ ID NO: 273 - DNA, 68 bp, synthetic construct
  source 1..68: mol_type = other DNA
ggatatactttttatttttgataaatatatatattttttatttttatatatatatatatcgtatatcc

SEQ ID NO: 274 - DNA, 68 bp, synthetic construct
  source 1..68: mol_type = other DNA
ggatatactttttatttttgataaatgtatatattttttatttttatatatacatatatcgtatatcc

SEQ ID NO: 275 - DNA, 68 bp, synthetic construct
  source 1..68: mol_type = other DNA
ggatatactttttatttttgatgatgtatatatatttttattttttatatatacatgatcgtatatcc

SEQ ID NO: 276 - DNA, 68 bp, synthetic construct
  source 1..68: mol_type = other DNA
ggatatactttttatttttgatgatatatgtacttttttatttttagtacatatatgatcgtatatcc

SEQ ID NO: 277 - DNA, 68 bp, synthetic construct
  source 1..68: mol_type = other DNA
ggtgatactttttattttttataaatatatatattttttatttttatatatatatatatagtatcacc

SEQ ID NO: 278 - DNA, 68 bp, synthetic construct
  source 1..68: mol_type = other DNA
ggtgatactttttatttttgataaatatatatattttttatttttatatatatatatatcgtatcacc

SEQ ID NO: 279 - DNA, 68 bp, synthetic construct
  source 1..68: mol_type = other DNA
ggtgatactttttatttttgataaatgtatatattttttatttttatatatacatatatcgtatcacc

SEQ ID NO: 280 - DNA, 68 bp, synthetic construct
  source 1..68: mol_type = other DNA
ggtgatactttttatttttgatgatgtatatatatttttattttttatatatacatgatcgtatcacc

SEQ ID NO: 281 - DNA, 68 bp, synthetic construct
  source 1..68: mol_type = other DNA
ggtgatactttttatttttgatgatatatgtacttttttatttttagtacatatatgatcgtatcacc

SEQ ID NO: 282 - DNA, 68 bp, synthetic construct
  source 1..68: mol_type = other DNA
ggtgatcctttttattttttataaatatatatattttttatttttatatatatatatataggatcacc

SEQ ID NO: 283 - DNA, 68 bp, synthetic construct
  source 1..68: mol_type = other DNA
ggtgatcctttttatttttgataaatatatatattttttatttttatatatatatatatcggatcacc

SEQ ID NO: 284 - DNA, 68 bp, synthetic construct
  source 1..68: mol_type = other DNA
ggtgatcctttttatttttgataaatgtatatattttttatttttatatatacatatatcggatcacc

SEQ ID NO: 285 - DNA, 68 bp, synthetic construct
  source 1..68: mol_type = other DNA
ggtgatcctttttatttttgatgatgtatatatatttttattttttatatatacatgatcggatcacc

SEQ ID NO: 286 - DNA, 68 bp, synthetic construct
  source 1..68: mol_type = other DNA
ggtgatcctttttatttttgatgatatatgtacttttttatttttagtacatatatgatcggatcacc

SEQ ID NO: 287 - DNA, 72 bp, synthetic construct
  source 1..72: mol_type = other DNA
gatatatcactttttattttttataaatatatatattttttatttttatatatatatatatagtgatatatc

SEQ ID NO: 288 - DNA, 72 bp, synthetic construct
  source 1..72: mol_type = other DNA
gtatatacattttttatttttgataaatatatatattttttatttttatatatatatatatcatgtatatac

SEQ ID NO: 289 - DNA, 72 bp, synthetic construct
  source 1..72: mol_type = other DNA
gtatatacattttttatttttgataaatgtatatattttttatttttatatatacatatatcatgtatatac

SEQ ID NO: 290 - DNA, 72 bp, synthetic construct
  source 1..72: mol_type = other DNA
gtatatacattttttatttttgatgatgtatatatatttttattttttatatatacatgatcatgtatatac

SEQ ID NO: 291 - DNA, 72 bp, synthetic construct
  source 1..72: mol_type = other DNA
gtatatacattttttatttttgatgatatatgtacttttttatttttagtacatatatgatcatgtatatac

SEQ ID NO: 292 - DNA, 72 bp, synthetic construct
  source 1..72: mol_type = other DNA
ggatatacactttttattttttataaatatatatattttttatttttatatatatatatatagtgtatatcc

SEQ ID NO: 293 - DNA, 72 bp, synthetic construct
  source 1..72: mol_type = other DNA
ggatatacattttttatttttgataaatatatatattttttatttttatatatatatatatcatgtatatcc

SEQ ID NO: 294 - DNA, 72 bp, synthetic construct
  source 1..72: mol_type = other DNA
ggatatacattttttatttttgataaatgtatatattttttatttttatatatacatatatcatgtatatcc

SEQ ID NO: 295 - DNA, 72 bp, synthetic construct
  source 1..72: mol_type = other DNA
ggatatacattttttatttttgatgatgtatatatatttttattttttatatatacatgatcatgtatatcc

SEQ ID NO: 296 - DNA, 72 bp, synthetic construct
  source 1..72: mol_type = other DNA
ggatatacattttttatttttgatgatatatgtacttttttatttttagtacatatatgatcatgtatatcc

SEQ ID NO: 297 - DNA, 72 bp, synthetic construct
  source 1..72: mol_type = other DNA
gggtatatactttttattttttataaatatatatattttttatttttatatatatatatatagtatataccc

SEQ ID NO: 298 - DNA, 72 bp, synthetic construct
  source 1..72: mol_type = other DNA
ggatatacactttttatttttgataaatatatatattttttatttttatatatatatatatcgtgtatatcc

SEQ ID NO: 299 - DNA, 72 bp, synthetic construct
  source 1..72: mol_type = other DNA
ggatatacactttttatttttgataaatgtatatattttttatttttatatatacatatatcgtgtatatcc

SEQ ID NO: 300 - DNA, 72 bp, synthetic construct
  source 1..72: mol_type = other DNA
ggatatacactttttatttttgatgatgtatatatatttttattttttatatatacatgatcgtgtatatcc

SEQ ID NO: 301 - DNA, 72 bp, synthetic construct
  source 1..72: mol_type = other DNA
ggatatacactttttatttttgatgatatatgtacttttttatttttagtacatatatgatcgtgtatatcc

SEQ ID NO: 302 - DNA, 72 bp, synthetic construct
  source 1..72: mol_type = other DNA
gggtatatactttttatttttgataaatatatatattttttatttttatatatatatatatcgtatataccc

SEQ ID NO: 303 - DNA, 72 bp, synthetic construct
  source 1..72: mol_type = other DNA
gggtatatactttttatttttgataaatgtatatattttttatttttatatatacatatatcgtatataccc

SEQ ID NO: 304 - DNA, 72 bp, synthetic construct
  source 1..72: mol_type = other DNA
gggtatatactttttatttttgatgatgtatatatatttttattttttatatatacatgatcgtatataccc

SEQ ID NO: 305 - DNA, 72 bp, synthetic construct
  source 1..72: mol_type = other DNA
gggtatatactttttatttttgatgatatatgtacttttttatttttagtacatatatgatcgtatataccc

SEQ ID NO: 306 - DNA, 66 bp, synthetic construct
  source 1..66: mol_type = other DNA
gtatatactttttatttttgataaatatatatatttttattttttatatatatatatcgtatatac

SEQ ID NO: 307 - DNA, 66 bp, synthetic construct
  source 1..66: mol_type = other DNA
gtatatactttttatttttgataaatgtatatatttttattttttatatacatatatcgtatatac

SEQ ID NO: 308 - DNA, 66 bp, synthetic construct
  source 1..66: mol_type = other DNA
gtatatactttttatttttgatgatgtatatattttttatttttatatatacatgatcgtatatac

SEQ ID NO: 309 - DNA, 66 bp, synthetic construct
  source 1..66: mol_type = other DNA
gtatatactttttatttttgatgatatatgtactttttatttttgtacatatatgatcgtatatac

SEQ ID NO: 310 - DNA, 66 bp, synthetic construct
  source 1..66: mol_type = other DNA
ggatatactttttatttttgataaatatatatatttttattttttatatatatatatcgtatatcc

SEQ ID NO: 311 - DNA, 66 bp, synthetic construct
  source 1..66: mol_type = other DNA
ggatatactttttatttttgataaatgtatatatttttattttttatatacatatatcgtatatcc

SEQ ID NO: 312 - DNA, 66 bp, synthetic construct
  source 1..66: mol_type = other DNA
ggatatactttttatttttgatgatgtatatattttttatttttatatatacatgatcgtatatcc

SEQ ID NO: 313 - DNA, 66 bp, synthetic construct
  source 1..66: mol_type = other DNA
ggatatactttttatttttgatgatatatgtactttttatttttgtacatatatgatcgtatatcc

SEQ ID NO: 314 - DNA, 66 bp, synthetic construct
  source 1..66: mol_type = other DNA
ggtgatactttttatttttgataaatatatatatttttattttttatatatatatatcgtatcacc

SEQ ID NO: 315 - DNA, 66 bp, synthetic construct
  source 1..66: mol_type = other DNA
ggtgatactttttatttttgataaatgtatatatttttattttttatatacatatatcgtatcacc

SEQ ID NO: 316 - DNA, 66 bp, synthetic construct
  source 1..66: mol_type = other DNA
ggtgatactttttatttttgatgatgtatatattttttatttttatatatacatgatcgtatcacc

SEQ ID NO: 317 - DNA, 66 bp, synthetic construct
  source 1..66: mol_type = other DNA
ggtgatactttttatttttgatgatatatgtactttttatttttgtacatatatgatcgtatcacc

SEQ ID NO: 318 - DNA, 66 bp, synthetic construct
  source 1..66: mol_type = other DNA
ggtgatcctttttatttttgataaatatatatatttttattttttatatatatatatcggatcacc

SEQ ID NO: 319 - DNA, 66 bp, synthetic construct
  source 1..66: mol_type = other DNA
ggtgatcctttttatttttgataaatgtatatatttttattttttatatacatatatcggatcacc

SEQ ID NO: 320 - DNA, 66 bp, synthetic construct
  source 1..66: mol_type = other DNA
ggtgatcctttttatttttgatgatgtatatattttttatttttatatatacatgatcggatcacc

SEQ ID NO: 321 - DNA, 66 bp, synthetic construct
  source 1..66: mol_type = other DNA
ggtgatcctttttatttttgatgatatatgtactttttatttttgtacatatatgatcggatcacc

SEQ ID NO: 322 - DNA, 70 bp, synthetic construct
  source 1..70: mol_type = other DNA
gtatatacattttttatttttgataaatatatatatttttattttttatatatatatatcatgtatatac

SEQ ID NO: 323 - DNA, 70 bp, synthetic construct
  source 1..70: mol_type = other DNA
gtatatacattttttatttttgatgatgtatatattttttatttttatatatacatgatcatgtatatac

SEQ ID NO: 324 - DNA, 70 bp, synthetic construct
  source 1..70: mol_type = other DNA
gtatatacattttttatttttgatgatatatgtactttttatttttgtacatatatgatcatgtatatac

SEQ ID NO: 325 - DNA, 70 bp, synthetic construct
  source 1..70: mol_type = other DNA
ggatatacattttttatttttgataaatatatatatttttattttttatatatatatatcatgtatatcc

SEQ ID NO: 326 - DNA, 70 bp, synthetic construct
  source 1..70: mol_type = other DNA
ggatatacattttttatttttgataaatgtatatatttttattttttatatacatatatcatgtatatcc

SEQ ID NO: 327 - DNA, 70 bp, synthetic construct
  source 1..70: mol_type = other DNA
ggatatacattttttatttttgatgatgtatatattttttatttttatatatacatgatcatgtatatcc

SEQ ID NO: 328 - DNA, 70 bp, synthetic construct
  source 1..70: mol_type = other DNA
ggatatacattttttatttttgatgatatatgtactttttatttttgtacatatatgatcatgtatatcc

SEQ ID NO: 329 - DNA, 70 bp, synthetic construct
  source 1..70: mol_type = other DNA
ggatatacactttttatttttgataaatatatatatttttattttttatatatatatatcgtgtatatcc

SEQ ID NO: 330 - DNA, 70 bp, synthetic construct
  source 1..70: mol_type = other DNA
ggatatacactttttatttttgataaatgtatatatttttattttttatatacatatatcgtgtatatcc

SEQ ID NO: 331 - DNA, 70 bp, synthetic construct
  source 1..70: mol_type = other DNA
ggatatacactttttatttttgatgatgtatatattttttatttttatatatacatgatcgtgtatatcc

SEQ ID NO: 332 - DNA, 70 bp, synthetic construct
  source 1..70: mol_type = other DNA
ggatatacactttttatttttgatgatatatgtactttttatttttgtacatatatgatcgtgtatatcc

SEQ ID NO: 333 - DNA, 70 bp, synthetic construct
  source 1..70: mol_type = other DNA
gggtatatactttttatttttgataaatatatatatttttattttttatatatatatatcgtatataccc

SEQ ID NO: 334 - DNA, 70 bp, synthetic construct
  source 1..70: mol_type = other DNA
gggtatatactttttatttttgataaatgtatatatttttattttttatatacatatatcgtatataccc

SEQ ID NO: 335 - DNA, 70 bp, synthetic construct
  source 1..70: mol_type = other DNA
gggtatatactttttatttttgatgatgtatatattttttatttttatatatacatgatcgtatataccc

SEQ ID NO: 336 - DNA, 70 bp, synthetic construct
  source 1..70: mol_type = other DNA
gggtatatactttttatttttgatgatatatgtactttttatttttgtacatatatgatcgtatataccc

SEQ ID NO: 337 - DNA, 68 bp, synthetic construct
  source 1..68: mol_type = other DNA
gatatatcactttttattttttataaatatatattttttatttttatatatatatatagtgatatatc

SEQ ID NO: 338 - DNA, 68 bp, synthetic construct
  source 1..68: mol_type = other DNA
gtatatacattttttatttttgataaatatatattttttatttttatatatatatatcatgtatatac

SEQ ID NO: 339 - DNA, 68 bp, synthetic construct
  source 1..68: mol_type = other DNA
gtatatacattttttatttttgatgatgtatatatttttattttttatatacatgatcatgtatatac

SEQ ID NO: 340 - DNA, 68 bp, synthetic construct
  source 1..68: mol_type = other DNA
gtatatacattttttatttttgatgatatatgtatttttattttttacatatatgatcatgtatatac

SEQ ID NO: 341 - DNA, 68 bp, synthetic construct
  source 1..68: mol_type = other DNA
ggatatacactttttattttttataaatatatattttttatttttatatatatatatagtgtatatcc

SEQ ID NO: 342 - DNA, 68 bp, synthetic construct
  source 1..68: mol_type = other DNA
ggatatacattttttatttttgataaatatatattttttatttttatatatatatatcatgtatatcc

SEQ ID NO: 343 - DNA, 68 bp, synthetic construct
  source 1..68: mol_type = other DNA
ggatatacattttttatttttgataaatgtatattttttatttttatatacatatatcatgtatatcc

SEQ ID NO: 344 - DNA, 68 bp, synthetic construct
  source 1..68: mol_type = other DNA
ggatatacattttttatttttgatgatgtatatatttttattttttatatacatgatcatgtatatcc

SEQ ID NO: 345 - DNA, 68 bp, synthetic construct
  source 1..68: mol_type = other DNA
ggatatacattttttatttttgatgatatatgtatttttattttttacatatatgatcatgtatatcc

SEQ ID NO: 346 - DNA, 68 bp, synthetic construct
  source 1..68: mol_type = other DNA
gggtatatactttttattttttataaatatatattttttatttttatatatatatatagtatataccc

SEQ ID NO: 347 - DNA, 68 bp, synthetic construct
  source 1..68: mol_type = other DNA
ggatatacactttttatttttgataaatatatattttttatttttatatatatatatcgtgtatatcc

SEQ ID NO: 348 - DNA, 68 bp, synthetic construct
  source 1..68: mol_type = other DNA
ggatatacactttttatttttgataaatgtatattttttatttttatatacatatatcgtgtatatcc

SEQ ID NO: 349 - DNA, 68 bp, synthetic construct
  source 1..68: mol_type = other DNA
ggatatacactttttatttttgatgatgtatatatttttattttttatatacatgatcgtgtatatcc

SEQ ID NO: 350 - DNA, 68 bp, synthetic construct
  source 1..68: mol_type = other DNA
ggatatacactttttatttttgatgatatatgtatttttattttttacatatatgatcgtgtatatcc

SEQ ID NO: 351 - DNA, 68 bp, synthetic construct
  source 1..68: mol_type = other DNA
gggtatatactttttatttttgataaatatatattttttatttttatatatatatatcgtatataccc

SEQ ID NO: 352 - DNA, 68 bp, synthetic construct
  source 1..68: mol_type = other DNA
gggtatatactttttatttttgataaatgtatattttttatttttatatacatatatcgtatataccc

SEQ ID NO: 353 - DNA, 68 bp, synthetic construct
  source 1..68: mol_type = other DNA
gggtatatactttttatttttgatgatgtatatatttttattttttatatacatgatcgtatataccc

SEQ ID NO: 354 - DNA, 68 bp, synthetic construct
  source 1..68: mol_type = other DNA
gggtatatactttttatttttgatgatatatgtatttttattttttacatatatgatcgtatataccc

SEQ ID NO: 355 - DNA, 66 bp, synthetic construct
  source 1..66: mol_type = other DNA
gtatatacattttttatttttgataaatatatatttttattttttatatatatatcatgtatatac

SEQ ID NO: 356 - DNA, 66 bp, synthetic construct
  source 1..66: mol_type = other DNA
gtatatacattttttatttttgatgatgtatattttttatttttatatacatgatcatgtatatac

SEQ ID NO: 357 - DNA, 66 bp, synthetic construct
  source 1..66: mol_type = other DNA
gtatatacattttttatttttgatgatatatgttttttatttttacatatatgatcatgtatatac

SEQ ID NO: 358 - DNA, 66 bp, synthetic construct
  source 1..66: mol_type = other DNA
ggatatacattttttatttttgataaatatatatttttattttttatatatatatcatgtatatcc

SEQ ID NO: 359 - DNA, 66 bp, synthetic construct
  source 1..66: mol_type = other DNA
ggatatacattttttatttttgataaatgtatatttttattttttatacatatatcatgtatatcc

SEQ ID NO: 360 - DNA, 66 bp, synthetic construct
  source 1..66: mol_type = other DNA
ggatatacattttttatttttgatgatgtatattttttatttttatatacatgatcatgtatatcc

SEQ ID NO: 361 - DNA, 66 bp, synthetic construct
  source 1..66: mol_type = other DNA
ggatatacattttttatttttgatgatatatgttttttatttttacatatatgatcatgtatatcc

SEQ ID NO: 362 - DNA, 66 bp, synthetic construct
  source 1..66: mol_type = other DNA
ggatatacactttttatttttgataaatatatatttttattttttatatatatatcgtgtatatcc

SEQ ID NO: 363 - DNA, 66 bp, synthetic construct
  source 1..66: mol_type = other DNA
ggatatacactttttatttttgataaatgtatatttttattttttatacatatatcgtgtatatcc

SEQ ID NO: 364 - DNA, 66 bp, synthetic construct
  source 1..66: mol_type = other DNA
ggatatacactttttatttttgatgatgtatattttttatttttatatacatgatcgtgtatatcc

SEQ ID NO: 365 - DNA, 66 bp, synthetic construct
  source 1..66: mol_type = other DNA
ggatatacactttttatttttgatgatatatgttttttatttttacatatatgatcgtgtatatcc

SEQ ID NO: 366 - DNA, 66 bp, synthetic construct
  source 1..66: mol_type = other DNA
gggtatatactttttatttttgataaatatatatttttattttttatatatatatcgtatataccc

SEQ ID NO: 367 - DNA, 66 bp, synthetic construct
  source 1..66: mol_type = other DNA
gggtatatactttttatttttgataaatgtatatttttattttttatacatatatcgtatataccc

SEQ ID NO: 368 - DNA, 66 bp, synthetic construct
  source 1..66: mol_type = other DNA
gggtatatactttttatttttgatgatgtatattttttatttttatatacatgatcgtatataccc

SEQ ID NO: 369 - DNA, 66 bp, synthetic construct
  source 1..66: mol_type = other DNA
gggtatatactttttatttttgatgatatatgttttttatttttacatatatgatcgtatataccc

SEQ ID NO: 370 - DNA, 64 bp, synthetic construct
  source 1..64: mol_type = other DNA
gtacatatatttttttatttttgataaatatatttttattttttatatatatcaatatatgtac

SEQ ID NO: 371 - DNA, 64 bp, synthetic construct
  source 1..64: mol_type = other DNA
gtacatatatttttttatttttgataaatgtatttttattttttacatatatcaatatatgtac

SEQ ID NO: 372 - DNA, 64 bp, synthetic construct
  source 1..64: mol_type = other DNA
gtacatatatttttttatttttgatgatgtattttttatttttatacatgatcaatatatgtac

SEQ ID NO: 373 - DNA, 64 bp, synthetic construct
  source 1..64: mol_type = other DNA
gtacatatatttttttatttttgatgatatattttttatttttatatatgatcaatatatgtac

SEQ ID NO: 374 - DNA, 64 bp, synthetic construct
  source 1..64: mol_type = other DNA
ggtacatatattttttatttttgataaatatatttttattttttatatatatcatatatgtacc

SEQ ID NO: 375 - DNA, 64 bp, synthetic construct
  source 1..64: mol_type = other DNA
ggtacatatattttttatttttgataaatgtatttttattttttacatatatcatatatgtacc

SEQ ID NO: 376 - DNA, 64 bp, synthetic construct
  source 1..64: mol_type = other DNA
ggtacatatattttttatttttgatgatgtattttttatttttatacatgatcatatatgtacc

SEQ ID NO: 377 - DNA, 64 bp, synthetic construct
  source 1..64: mol_type = other DNA
ggtacatatattttttatttttgatgatatattttttatttttatatatgatcatatatgtacc

SEQ ID NO: 378 - DNA, 66 bp, synthetic construct
  source 1..66: mol_type = other DNA
cgatcatatatttttttatttttgataaatatatttttattttttatatatatcaatatatgatcg

SEQ ID NO: 379 - DNA, 66 bp, synthetic construct
  source 1..66: mol_type = other DNA
cgatcatatatttttttatttttgataaatgtatttttattttttacatatatcaatatatgatcg

SEQ ID NO: 380 - DNA, 66 bp, synthetic construct
  source 1..66: mol_type = other DNA
cgatcatatatttttttatttttgatgatgtattttttatttttatacatgatcaatatatgatcg

SEQ ID NO: 381 - DNA, 66 bp, synthetic construct
  source 1..66: mol_type = other DNA
cgatcatatatttttttatttttgatgatatattttttatttttatatatgatcaatatatgatcg

SEQ ID NO: 382 - DNA, 68 bp, synthetic construct
  source 1..68: mol_type = other DNA
gtatatactttttatttttgatgatgtaaatatatttttattttttatatatacatgatcgtatatac

SEQ ID NO: 383 - DNA, 68 bp, synthetic construct
  source 1..68: mol_type = other DNA
gtatatactttttatttttgatgatataagtacttttttatttttagtacatatatgatcgtatatac

SEQ ID NO: 384 - DNA, 68 bp, synthetic construct
  source 1..68: mol_type = other DNA
ggatatactttttatttttgatgatgtaaatatatttttattttttatatatacatgatcgtatatcc

SEQ ID NO: 385 - DNA, 68 bp, synthetic construct
  source 1..68: mol_type = other DNA
ggatatactttttatttttgatgatataagtacttttttatttttagtacatatatgatcgtatatcc

SEQ ID NO: 386 - DNA, 68 bp, synthetic construct
  source 1..68: mol_type = other DNA
ggtgatactttttatttttgatgatgtaaatatatttttattttttatatatacatgatcgtatcacc

SEQ ID NO: 387 - DNA, 68 bp, synthetic construct
  source 1..68: mol_type = other DNA
ggtgatactttttatttttgatgatataagtacttttttatttttagtacatatatgatcgtatcacc

SEQ ID NO: 388 - DNA, 68 bp, synthetic construct
  source 1..68: mol_type = other DNA
ggtgatcctttttatttttgatgatgtaaatatatttttattttttatatatacatgatcggatcacc

SEQ ID NO: 389 - DNA, 68 bp, synthetic construct
  source 1..68: mol_type = other DNA
ggtgatcctttttatttttgatgatataagtacttttttatttttagtacatatatgatcggatcacc

SEQ ID NO: 390 - DNA, 72 bp, synthetic construct
  source 1..72: mol_type = other DNA
gtatatacattttttatttttgatgatgtaaatatatttttattttttatatatacatgatcatgtatatac

SEQ ID NO: 391 - DNA, 72 bp, synthetic construct
  source 1..72: mol_type = other DNA
gtatatacattttttatttttgatgatataagtacttttttatttttagtacatatatgatcatgtatatac

SEQ ID NO: 392 - DNA, 72 bp, synthetic construct
  source 1..72: mol_type = other DNA
ggatatacattttttatttttgataaatgtaaatattttttatttttatatatacatatatcatgtatatcc

SEQ ID NO: 393 - DNA, 72 bp, synthetic construct
  source 1..72: mol_type = other DNA
ggatatacattttttatttttgatgatgtaaatatatttttattttttatatatacatgatcatgtatatcc

SEQ ID NO: 394 - DNA, 72 bp, synthetic construct
  source 1..72: mol_type = other DNA
ggatatacattttttatttttgatgatataagtacttttttatttttagtacatatatgatcatgtatatcc

SEQ ID NO: 395 - DNA, 72 bp, synthetic construct
  source 1..72: mol_type = other DNA
ggatatacactttttatttttgatgatgtaaatatatttttattttttatatatacatgatcgtgtatatcc

SEQ ID NO: 396 - DNA, 72 bp, synthetic construct
  source 1..72: mol_type = other DNA
ggatatacactttttatttttgatgatataagtacttttttatttttagtacatatatgatcgtgtatatcc

SEQ ID NO: 397 - DNA, 72 bp, synthetic construct
  source 1..72: mol_type = other DNA
gggtatatactttttatttttgatgatgtaaatatatttttattttttatatatacatgatcgtatataccc

SEQ ID NO: 398 - DNA, 72 bp, synthetic construct
  source 1..72: mol_type = other DNA
gggtatatactttttatttttgatgatataagtacttttttatttttagtacatatatgatcgtatataccc

SEQ ID NO: 399 - DNA, 66 bp, synthetic construct
  source 1..66: mol_type = other DNA
gtatatactttttatttttgatgatgtaaatattttttatttttatatatacatgatcgtatatac

SEQ ID NO: 400 - DNA, 66 bp, synthetic construct
  source 1..66: mol_type = other DNA
gtatatactttttatttttgatgatataagtactttttatttttgtacatatatgatcgtatatac

SEQ ID NO: 401 - DNA, 66 bp, synthetic construct
  source 1..66: mol_type = other DNA
ggatatactttttatttttgatgatgtaaatattttttatttttatatatacatgatcgtatatcc

SEQ ID NO: 402 - DNA, 66 bp, synthetic construct
  source 1..66: mol_type = other DNA
ggatatactttttatttttgatgatataagtactttttatttttgtacatatatgatcgtatatcc

SEQ ID NO: 403 - DNA, 66 bp, synthetic construct
  source 1..66: mol_type = other DNA
ggtgatactttttatttttgatgatgtaaatattttttatttttatatatacatgatcgtatcacc

SEQ ID NO: 404 - DNA, 66 bp, synthetic construct
  source 1..66: mol_type = other DNA
ggtgatactttttatttttgatgatataagtactttttatttttgtacatatatgatcgtatcacc

SEQ ID NO: 405 - DNA, 66 bp, synthetic construct
  source 1..66: mol_type = other DNA
ggtgatcctttttatttttgatgatgtaaatattttttatttttatatatacatgatcggatcacc

SEQ ID NO: 406 - DNA, 66 bp, synthetic construct
  source 1..66: mol_type = other DNA
ggtgatcctttttatttttgatgatataagtactttttatttttgtacatatatgatcggatcacc

SEQ ID NO: 407 - DNA, 70 bp, synthetic construct
  source 1..70: mol_type = other DNA
gtatatacattttttatttttgatgatgtaaatattttttatttttatatatacatgatcatgtatatac

SEQ ID NO: 408 - DNA, 70 bp, synthetic construct
  source 1..70: mol_type = other DNA
gtatatacattttttatttttgatgatataagtactttttatttttgtacatatatgatcatgtatatac

SEQ ID NO: 409 - DNA, 70 bp, synthetic construct
  source 1..70: mol_type = other DNA
ggatatacattttttatttttgatgatgtaaatattttttatttttatatatacatgatcatgtatatcc

SEQ ID NO: 410 - DNA, 70 bp, synthetic construct
  source 1..70: mol_type = other DNA
ggatatacattttttatttttgatgatataagtactttttatttttgtacatatatgatcatgtatatcc

SEQ ID NO: 411 - DNA, 70 bp, synthetic construct
  source 1..70: mol_type = other DNA
ggatatacactttttatttttgatgatgtaaatattttttatttttatatatacatgatcgtgtatatcc

SEQ ID NO: 412 - DNA, 70 bp, synthetic construct
  source 1..70: mol_type = other DNA
ggatatacactttttatttttgatgatataagtactttttatttttgtacatatatgatcgtgtatatcc

SEQ ID NO: 413 - DNA, 70 bp, synthetic construct
  source 1..70: mol_type = other DNA
gggtatatactttttatttttgatgatgtaaatattttttatttttatatatacatgatcgtatataccc

SEQ ID NO: 414 - DNA, 70 bp, synthetic construct
  source 1..70: mol_type = other DNA
gggtatatactttttatttttgatgatataagtactttttatttttgtacatatatgatcgtatataccc

SEQ ID NO: 415 - DNA, 68 bp, synthetic construct
  source 1..68: mol_type = other DNA
gtatatacattttttatttttgatgatataagtatttttattttttacatatatgatcatgtatatac

SEQ ID NO: 416 - DNA, 68 bp, synthetic construct
  source 1..68: mol_type = other DNA
ggatatacattttttatttttgataaatgaatattttttatttttatatacatatatcatgtatatcc

SEQ ID NO: 417 - DNA, 68 bp, synthetic construct
  source 1..68: mol_type = other DNA
ggatatacattttttatttttgatgatataagtatttttattttttacatatatgatcatgtatatcc

SEQ ID NO: 418 - DNA, 68 bp, synthetic construct
  source 1..68: mol_type = other DNA
ggatatacactttttatttttgataaatgaatattttttatttttatatacatatatcgtgtatatcc

SEQ ID NO: 419 - DNA, 68 bp, synthetic construct
  source 1..68: mol_type = other DNA
ggatatacactttttatttttgatgatataagtatttttattttttacatatatgatcgtgtatatcc

SEQ ID NO: 420 - DNA, 68 bp, synthetic construct
  source 1..68: mol_type = other DNA
gggtatatactttttatttttgataaatgaatattttttatttttatatacatatatcgtatataccc

SEQ ID NO: 421 - DNA, 68 bp, synthetic construct
  source 1..68: mol_type = other DNA
gggtatatactttttatttttgatgatataagtatttttattttttacatatatgatcgtatataccc

SEQ ID NO: 422 - DNA, 66 bp, synthetic construct
  source 1..66: mol_type = other DNA
gtatatacattttttatttttgatgatgaatattttttatttttatatacatgatcatgtatatac

SEQ ID NO: 423 - DNA, 66 bp, synthetic construct
  source 1..66: mol_type = other DNA
ggatatacattttttatttttgataaatgaatatttttattttttatacatatatcatgtatatcc

SEQ ID NO: 424 - DNA, 66 bp, synthetic construct
  source 1..66: mol_type = other DNA
ggatatacattttttatttttgatgatgaatattttttatttttatatacatgatcatgtatatcc

SEQ ID NO: 425 - DNA, 66 bp, synthetic construct
  source 1..66: mol_type = other DNA
ggatatacattttttatttttgatgataaatgttttttatttttacatatatgatcatgtatatcc

SEQ ID NO: 426 - DNA, 66 bp, synthetic construct
  source 1..66: mol_type = other DNA
ggatatacactttttatttttgatgatgaatattttttatttttatatacatgatcgtgtatatcc

SEQ ID NO: 427 - DNA, 66 bp, synthetic construct
  source 1..66: mol_type = other DNA
gggtatatactttttatttttgatgatgaatattttttatttttatatacatgatcgtatataccc

SEQ ID NO: 428 - DNA, 62 bp, synthetic construct
  source 1..62: mol_type = other DNA
gatactttttatttttgatgatgtaaatatatttttattttttatatatacatgatcgtatc

SEQ ID NO: 429 - DNA, 62 bp, synthetic construct
  source 1..62: mol_type = other DNA
gatactttttatttttgatgatataagtacttttttatttttagtacatatatgatcgtatc

SEQ ID NO: 430 - DNA, 62 bp, synthetic construct
  source 1..62: mol_type = other DNA
gacactttttatttttgatgatgtaaatatatttttattttttatatatacatgatcgtgtc

SEQ ID NO: 431 - DNA, 62 bp, synthetic construct
  source 1..62: mol_type = other DNA
gacactttttatttttgatgatataagtacttttttatttttagtacatatatgatcgtgtc

SEQ ID NO: 432 - DNA, 62 bp, synthetic construct
  source 1..62: mol_type = other DNA
ggatctttttatttttgatgatgtaaatatatttttattttttatatatacatgatcgatcc

SEQ ID NO: 433 - DNA, 62 bp, synthetic construct
  source 1..62: mol_type = other DNA
ggatctttttatttttgatgatataagtacttttttatttttagtacatatatgatcgatcc

SEQ ID NO: 434 - DNA, 62 bp, synthetic construct
  source 1..62: mol_type = other DNA
gcgtctttttatttttgatgatgtaaatatatttttattttttatatatacatgatcgacgc

SEQ ID NO: 435 - DNA, 62 bp, synthetic construct
  source 1..62: mol_type = other DNA
gcgtctttttatttttgatgatataagtacttttttatttttagtacatatatgatcgacgc

SEQ ID NO: 436 - DNA, 62 bp, synthetic construct
  source 1..62: mol_type = other DNA
gtatactttttatttttgatgatgtaaatattttttatttttatatatacatgatcgtatac

SEQ ID NO: 437 - DNA, 62 bp, synthetic construct
  source 1..62: mol_type = other DNA
gtatactttttatttttgatgatataagtactttttatttttgtacatatatgatcgtatac

SEQ ID NO: 438 - DNA, 62 bp, synthetic construct
  source 1..62: mol_type = other DNA
gtgatctttttatttttgatgatgtaaatattttttatttttatatatacatgatcgatcac

SEQ ID NO: 439 - DNA, 62 bp, synthetic construct
  source 1..62: mol_type = other DNA
gtgatctttttatttttgatgatataagtactttttatttttgtacatatatgatcgatcac

SEQ ID NO: 440 - DNA, 62 bp, synthetic construct
  source 1..62: mol_type = other DNA
ggatactttttatttttgatgatgtaaatattttttatttttatatatacatgatcgtatcc

SEQ ID NO: 441 - DNA, 62 bp, synthetic construct
  source 1..62: mol_type = other DNA
ggatactttttatttttgatgatataagtactttttatttttgtacatatatgatcgtatcc

SEQ ID NO: 442 - DNA, 62 bp, synthetic construct
  source 1..62: mol_type = other DNA
gcgatctttttatttttgatgatgtaaatattttttatttttatatatacatgatcgatcgc

SEQ ID NO: 443 - DNA, 62 bp, synthetic construct
  source 1..62: mol_type = other DNA
gcgatctttttatttttgatgatataagtactttttatttttgtacatatatgatcgatcgc

SEQ ID NO: 444 - DNA, 62 bp, synthetic construct
  source 1..62: mol_type = other DNA
gatatattttttatttttgatgatataagtatttttattttttacatatatgatcatatatc

SEQ ID NO: 445 - DNA, 62 bp, synthetic construct
  source 1..62: mol_type = other DNA
gatatactttttatttttgatgatataagtatttttattttttacatatatgatcgtatatc

SEQ ID NO: 446 - DNA, 62 bp, synthetic construct
  source 1..62: mol_type = other DNA
gtgatactttttatttttgataaatgaatattttttatttttatatacatatatcgtatcac

SEQ ID NO: 447 - DNA, 62 bp, synthetic construct
  source 1..62: mol_type = other DNA
gtgatactttttatttttgatgatataagtatttttattttttacatatatgatcgtatcac

SEQ ID NO: 448 - DNA, 62 bp, synthetic construct
  source 1..62: mol_type = other DNA
ggtatactttttatttttgataaatgaatattttttatttttatatacatatatcgtatacc

SEQ ID NO: 449 - DNA, 62 bp, synthetic construct
  source 1..62: mol_type = other DNA
ggtatactttttatttttgatgatataagtatttttattttttacatatatgatcgtatacc

SEQ ID NO: 450 - DNA, 62 bp, synthetic construct
  source 1..62: mol_type = other DNA
ggtgtactttttatttttgataaatgaatattttttatttttatatacatatatcgtacacc

SEQ ID NO: 451 - DNA, 62 bp, synthetic construct
  source 1..62: mol_type = other DNA
ggtgtactttttatttttgatgatataagtatttttattttttacatatatgatcgtacacc

SEQ ID NO: 452 - DNA, 62 bp, synthetic construct
  source 1..62: mol_type = other DNA
gtatatactttttatttttgatgatgaatattttttatttttatatacatgatcgtatatac

SEQ ID NO: 453 - DNA, 62 bp, synthetic construct
  source 1..62: mol_type = other DNA
gtatatactttttatttttgatgataaatgttttttatttttacatatatgatcgtatatac

SEQ ID NO: 454 - DNA, 62 bp, synthetic construct
  source 1..62: mol_type = other DNA
ggatatactttttatttttgatgatgaatattttttatttttatatacatgatcgtatatcc

SEQ ID NO: 455 - DNA, 62 bp, synthetic construct
  source 1..62: mol_type = other DNA
ggtgatactttttatttttgatgatgaatattttttatttttatatacatgatcgtatcacc

SEQ ID NO: 456 - DNA, 62 bp, synthetic construct
  source 1..62: mol_type = other DNA
ggtgatactttttatttttgatgataaatgttttttatttttacatatatgatcgtatcacc

SEQ ID NO: 457 - DNA, 62 bp, synthetic construct
  source 1..62: mol_type = other DNA
ggtgatcctttttatttttgatgatgaatattttttatttttatatacatgatcggatcacc

SEQ ID NO: 458 - DNA, 62 bp, synthetic construct
  source 1..62: mol_type = other DNA
gatactttttatttttgatataaatatataatttttatttttatatatatatatatcgtatc

SEQ ID NO: 459 - DNA, 62 bp, synthetic construct
  source 1..62: mol_type = other DNA
gatactttttatttttgataaatgaatatattttttatttttatatatacatatatcgtatc

SEQ ID NO: 460 - DNA, 62 bp, synthetic construct
  source 1..62: mol_type = other DNA
gacactttttatttttgatataaatatataatttttatttttatatatatatatatcgtgtc

SEQ ID NO: 461 - DNA, 62 bp, synthetic construct
  source 1..62: mol_type = other DNA
gacactttttatttttgataaatgaatatattttttatttttatatatacatatatcgtgtc

SEQ ID NO: 462 - DNA, 62 bp, synthetic construct
  source 1..62: mol_type = other DNA
gacactttttatttttgatataagtaaatattttttatttttatatatacatatatcgtgtc

SEQ ID NO: 463 - DNA, 62 bp, synthetic construct
  source 1..62: mol_type = other DNA
ggatctttttatttttgatataaatatataatttttatttttatatatatatatatcgatcc

SEQ ID NO: 464 - DNA, 62 bp, synthetic construct
  source 1..62: mol_type = other DNA
ggatctttttatttttgataaatgaatatattttttatttttatatatacatatatcgatcc

SEQ ID NO: 465 - DNA, 62 bp, synthetic construct
  source 1..62: mol_type = other DNA
ggatctttttatttttgatataagtaaatattttttatttttatatatacatatatcgatcc

SEQ ID NO: 466 - DNA, 62 bp, synthetic construct
  source 1..62: mol_type = other DNA
gcgtctttttatttttgatataaatatataatttttatttttatatatatatatatcgacgc

SEQ ID NO: 467 - DNA, 62 bp, synthetic construct
  source 1..62: mol_type = other DNA
gcgtctttttatttttgataaatgaatatattttttatttttatatatacatatatcgacgc

SEQ ID NO: 468 - DNA, 62 bp, synthetic construct
  source 1..62: mol_type = other DNA
gcgtctttttatttttgatataagtaaatattttttatttttatatatacatatatcgacgc

SEQ ID NO: 469 - DNA, 72 bp, synthetic construct
  source 1..72: mol_type = other DNA
gtatatacattttttatttttgatataaatatataatttttatttttatatatatatatatcatgtatatac

SEQ ID NO: 470 - DNA, 72 bp, synthetic construct
  source 1..72: mol_type = other DNA
gtatatacattttttatttttgataaatgaatatattttttatttttatatatacatatatcatgtatatac

SEQ ID NO: 471 - DNA, 72 bp, synthetic construct
  source 1..72: mol_type = other DNA
gtatatacattttttatttttgatataagtaaatattttttatttttatatatacatatatcatgtatatac

SEQ ID NO: 472 - DNA, 72 bp, synthetic construct
  source 1..72: mol_type = other DNA
ggatatacattttttatttttgatataaatatataatttttatttttatatatatatatatcatgtatatcc

SEQ ID NO: 473 - DNA, 72 bp, synthetic construct
  source 1..72: mol_type = other DNA
ggatatacactttttatttttgatataaatatataatttttatttttatatatatatatatcgtgtatatcc

SEQ ID NO: 474 - DNA, 72 bp, synthetic construct
  source 1..72: mol_type = other DNA
ggatatacactttttatttttgataaatgaatatattttttatttttatatatacatatatcgtgtatatcc

SEQ ID NO: 475 - DNA, 72 bp, synthetic construct
  source 1..72: mol_type = other DNA
ggatatacactttttatttttgatataagtaaatattttttatttttatatatacatatatcgtgtatatcc

SEQ ID NO: 476 - DNA, 72 bp, synthetic construct
  source 1..72: mol_type = other DNA
gggtatatactttttatttttgatataaatatataatttttatttttatatatatatatatcgtatataccc

SEQ ID NO: 477 - DNA, 72 bp, synthetic construct
  source 1..72: mol_type = other DNA
gggtatatactttttatttttgataaatgaatatattttttatttttatatatacatatatcgtatataccc

SEQ ID NO: 478 - DNA, 72 bp, synthetic construct
  source 1..72: mol_type = other DNA
gggtatatactttttatttttgatataagtaaatattttttatttttatatatacatatatcgtatataccc

SEQ ID NO: 479 - DNA, 62 bp, synthetic construct
  source 1..62: mol_type = other DNA
gtatactttttattttttataaatatatatttttttattttttatatatatatatagtatac

SEQ ID NO: 480 - DNA, 62 bp, synthetic construct
  source 1..62: mol_type = other DNA
gtgatctttttattttttataaatatatatttttttattttttatatatatatatagatcac

SEQ ID NO: 481 - DNA, 62 bp, synthetic construct
  source 1..62: mol_type = other DNA
gtatactttttatttttgatataaatatatttttttattttttatatatatatatcgtatac

SEQ ID NO: 482 - DNA, 62 bp, synthetic construct
  source 1..62: mol_type = other DNA
gtatactttttatttttgatatataaatatttttttattttttatatatatatatcgtatac

SEQ ID NO: 483 - DNA, 62 bp, synthetic construct
  source 1..62: mol_type = other DNA
gtatactttttatttttgataaatgaatatatttttattttttatatacatatatcgtatac

SEQ ID NO: 484 - DNA, 62 bp, synthetic construct
  source 1..62: mol_type = other DNA
ggatactttttattttttataaatatatatttttttattttttatatatatatatagtatcc

SEQ ID NO: 485 - DNA, 62 bp, synthetic construct
  source 1..62: mol_type = other DNA
gtgatctttttatttttgatataaatatatttttttattttttatatatatatatcgatcac

SEQ ID NO: 486 - DNA, 62 bp, synthetic construct
  source 1..62: mol_type = other DNA
gtgatctttttatttttgatatataaatatttttttattttttatatatatatatcgatcac

SEQ ID NO: 487 - DNA, 62 bp, synthetic construct
  source 1..62: mol_type = other DNA
gtgatctttttatttttgataaatgaatatatttttattttttatatacatatatcgatcac

SEQ ID NO: 488 - DNA, 62 bp, synthetic construct
  source 1..62: mol_type = other DNA
ggatactttttatttttgatataaatatatttttttattttttatatatatatatcgtatcc

SEQ ID NO: 489 - DNA, 62 bp, synthetic construct
  source 1..62: mol_type = other DNA
ggatactttttatttttgatatataaatatttttttattttttatatatatatatcgtatcc

SEQ ID NO: 490 - DNA, 62 bp, synthetic construct
  source 1..62: mol_type = other DNA
ggatactttttatttttgataaatgaatatatttttattttttatatacatatatcgtatcc

SEQ ID NO: 491 - DNA, 62 bp, synthetic construct
  source 1..62: mol_type = other DNA
gcgatctttttattttttataaatatatatttttttattttttatatatatatatagatcgc

SEQ ID NO: 492 - DNA, 62 bp, synthetic construct
  source 1..62: mol_type = other DNA
gcgatctttttatttttgatataaatatatttttttattttttatatatatatatcgatcgc

SEQ ID NO: 493 - DNA, 62 bp, synthetic construct
  source 1..62: mol_type = other DNA
gcgatctttttatttttgatatataaatatttttttattttttatatatatatatcgatcgc

SEQ ID NO: 494 - DNA, 62 bp, synthetic construct
  source 1..62: mol_type = other DNA
gcgatctttttatttttgataaatgaatatatttttattttttatatacatatatcgatcgc

SEQ ID NO: 495 - DNA, 70 bp, synthetic construct
  source 1..70: mol_type = other DNA
gatatatcactttttattttttataaatatatatttttttattttttatatatatatatagtgatatatc

SEQ ID NO: 496 - DNA, 70 bp, synthetic construct
  source 1..70: mol_type = other DNA
gtatatacattttttatttttgatataaatatatttttttattttttatatatatatatcatgtatatac

SEQ ID NO: 497 - DNA, 70 bp, synthetic construct
  source 1..70: mol_type = other DNA
gtatatacattttttatttttgatatataaatatttttttattttttatatatatatatcatgtatatac

SEQ ID NO: 498 - DNA, 70 bp, synthetic construct
  source 1..70: mol_type = other DNA
ggatatacactttttattttttataaatatatatttttttattttttatatatatatatagtgtatatcc

SEQ ID NO: 499 - DNA, 70 bp, synthetic construct
  source 1..70: mol_type = other DNA
ggatatacattttttatttttgatataaatatatttttttattttttatatatatatatcatgtatatcc

SEQ ID NO: 500 - DNA, 70 bp, synthetic construct
  source 1..70: mol_type = other DNA
ggatatacattttttatttttgatatataaatatttttttattttttatatatatatatcatgtatatcc

SEQ ID NO: 501 - DNA, 70 bp, synthetic construct
  source 1..70: mol_type = other DNA
ggatatacattttttatttttgataaatgaatatatttttattttttatatacatatatcatgtatatcc

SEQ ID NO: 502 - DNA, 70 bp, synthetic construct
  source 1..70: mol_type = other DNA
gggtatatactttttattttttataaatatatatttttttattttttatatatatatatagtatataccc

SEQ ID NO: 503 - DNA, 70 bp, synthetic construct
  source 1..70: mol_type = other DNA
ggatatacactttttatttttgatataaatatatttttttattttttatatatatatatcgtgtatatcc

SEQ ID NO: 504 - DNA, 70 bp, synthetic construct
  source 1..70: mol_type = other DNA
ggatatacactttttatttttgatatataaatatttttttattttttatatatatatatcgtgtatatcc

SEQ ID NO: 505 - DNA, 70 bp, synthetic construct
  source 1..70: mol_type = other DNA
ggatatacactttttatttttgataaatgaatatatttttattttttatatacatatatcgtgtatatcc

SEQ ID NO: 506 - DNA, 70 bp, synthetic construct
  source 1..70: mol_type = other DNA
gggtatatactttttatttttgatataaatatatttttttattttttatatatatatatcgtatataccc

SEQ ID NO: 507 - DNA, 70 bp, synthetic construct
  source 1..70: mol_type = other DNA
gggtatatactttttatttttgatatataaatatttttttattttttatatatatatatcgtatataccc

SEQ ID NO: 508 - DNA, 70 bp, synthetic construct
  source 1..70: mol_type = other DNA
gggtatatactttttatttttgataaatgaatatatttttattttttatatacatatatcgtatataccc

SEQ ID NO: 509 - DNA, 62 bp, synthetic construct
  source 1..62: mol_type = other DNA
gatatactttttatttttgataaatatataatttttatttttatatatatatatcgtatatc

SEQ ID NO: 510 - DNA, 62 bp, synthetic construct
  source 1..62: mol_type = other DNA
gtgatactttttatttttgataaatatataatttttatttttatatatatatatcgtatcac

SEQ ID NO: 511 - DNA, 62 bp, synthetic construct
  source 1..62: mol_type = other DNA
ggtatactttttatttttgataaatatataatttttatttttatatatatatatcgtatacc

SEQ ID NO: 512 - DNA, 62 bp, synthetic construct
  source 1..62: mol_type = other DNA
ggtgtactttttatttttgataaatatataatttttatttttatatatatatatcgtacacc

SEQ ID NO: 513 - DNA, 68 bp, synthetic construct
  source 1..68: mol_type = other DNA
gtatatacattttttatttttgataaatatataatttttatttttatatatatatatcatgtatatac

SEQ ID NO: 514 - DNA, 68 bp, synthetic construct
  source 1..68: mol_type = other DNA
ggatatacattttttatttttgataaatatataatttttatttttatatatatatatcatgtatatcc

SEQ ID NO: 515 - DNA, 68 bp, synthetic construct
  source 1..68: mol_type = other DNA
ggatatacactttttatttttgataaatatataatttttatttttatatatatatatcgtgtatatcc

SEQ ID NO: 516 - DNA, 68 bp, synthetic construct
  source 1..68: mol_type = other DNA
gggtatatactttttatttttgataaatatataatttttatttttatatatatatatcgtatataccc

SEQ ID NO: 517 - DNA, 62 bp, synthetic construct
  source 1..62: mol_type = other DNA
gtatatactttttatttttgataaatatatttttttattttttatatatatatcgtatatac

SEQ ID NO: 518 - DNA, 62 bp, synthetic construct
  source 1..62: mol_type = other DNA
gtatatactttttatttttgataaatgtatttttttattttttatacatatatcgtatatac

SEQ ID NO: 519 - DNA, 62 bp, synthetic construct
  source 1..62: mol_type = other DNA
ggatatactttttatttttgataaatatatttttttattttttatatatatatcgtatatcc

SEQ ID NO: 520 - DNA, 62 bp, synthetic construct
  source 1..62: mol_type = other DNA
ggatatactttttatttttgataaatgtatttttttattttttatacatatatcgtatatcc

SEQ ID NO: 521 - DNA, 62 bp, synthetic construct
  source 1..62: mol_type = other DNA
ggatatactttttatttttgatgataaatgttttttatttttacatatatgatcgtatatcc

SEQ ID NO: 522 - DNA, 62 bp, synthetic construct
  source 1..62: mol_type = other DNA
ggtgatactttttatttttgataaatatatttttttattttttatatatatatcgtatcacc

SEQ ID NO: 523 - DNA, 62 bp, synthetic construct
  source 1..62: mol_type = other DNA
ggtgatactttttatttttgataaatgtatttttttattttttatacatatatcgtatcacc

SEQ ID NO: 524 - DNA, 62 bp, synthetic construct
  source 1..62: mol_type = other DNA
ggtgatcctttttatttttgataaatatatttttttattttttatatatatatcggatcacc

SEQ ID NO: 525 - DNA, 62 bp, synthetic construct
  source 1..62: mol_type = other DNA
ggtgatcctttttatttttgataaatgtatttttttattttttatacatatatcggatcacc

SEQ ID NO: 526 - DNA, 62 bp, synthetic construct
  source 1..62: mol_type = other DNA
ggtgatcctttttatttttgatgataaatgttttttatttttacatatatgatcggatcacc

SEQ ID NO: 527 - DNA, 66 bp, synthetic construct
  source 1..66: mol_type = other DNA
gtatatacattttttatttttgataaatatatttttttattttttatatatatatcatgtatatac

SEQ ID NO: 528 - DNA, 66 bp, synthetic construct
  source 1..66: mol_type = other DNA
gtatatacattttttatttttgataaatgtatttttttattttttatacatatatcatgtatatac

SEQ ID NO: 529 - DNA, 66 bp, synthetic construct
  source 1..66: mol_type = other DNA
gtatatacattttttatttttgatgataaatgttttttatttttacatatatgatcatgtatatac

SEQ ID NO: 530 - DNA, 66 bp, synthetic construct
  source 1..66: mol_type = other DNA
ggatatacattttttatttttgataaatatatttttttattttttatatatatatcatgtatatcc

SEQ ID NO: 531 - DNA, 66 bp, synthetic construct
  source 1..66: mol_type = other DNA
ggatatacactttttatttttgataaatatatttttttattttttatatatatatcgtgtatatcc

SEQ ID NO: 532 - DNA, 66 bp, synthetic construct
  source 1..66: mol_type = other DNA
ggatatacactttttatttttgataaatgtatttttttattttttatacatatatcgtgtatatcc

SEQ ID NO: 533 - DNA, 66 bp, synthetic construct
  source 1..66: mol_type = other DNA
ggatatacactttttatttttgatgataaatgttttttatttttacatatatgatcgtgtatatcc

SEQ ID NO: 534 - DNA, 66 bp, synthetic construct
  source 1..66: mol_type = other DNA
gggtatatactttttatttttgataaatatatttttttattttttatatatatatcgtatataccc

SEQ ID NO: 535 - DNA, 66 bp, synthetic construct
  source 1..66: mol_type = other DNA
gggtatatactttttatttttgataaatgtatttttttattttttatacatatatcgtatataccc

SEQ ID NO: 536 - DNA, 66 bp, synthetic construct
  source 1..66: mol_type = other DNA
gggtatatactttttatttttgatgataaatgttttttatttttacatatatgatcgtatataccc

SEQ ID NO: 537 - DNA, 62 bp, synthetic construct
  source 1..62: mol_type = other DNA
gtatatacattttttatttttgataaatatttttttattttttatatatatcatgtatatac

SEQ ID NO: 538 - DNA, 62 bp, synthetic construct
  source 1..62: mol_type = other DNA
gtatatacattttttatttttgataaatgtttttttattttttacatatatcatgtatatac

SEQ ID NO: 539 - DNA, 62 bp, synthetic construct
  source 1..62: mol_type = other DNA
ggatatacattttttatttttgataaatatttttttattttttatatatatcatgtatatcc

SEQ ID NO: 540 - DNA, 62 bp, synthetic construct
  source 1..62: mol_type = other DNA
ggatatacattttttatttttgataaatgtttttttattttttacatatatcatgtatatcc

SEQ ID NO: 541 - DNA, 62 bp, synthetic construct
  source 1..62: mol_type = other DNA
ggatatacattttttatttttgatgatgaattttttatttttatacatgatcatgtatatcc

SEQ ID NO: 542 - DNA, 62 bp, synthetic construct
  source 1..62: mol_type = other DNA
ggatatacactttttatttttgataaatatttttttattttttatatatatcgtgtatatcc

SEQ ID NO: 543 - DNA, 62 bp, synthetic construct
  source 1..62: mol_type = other DNA
ggatatacactttttatttttgataaatgtttttttattttttacatatatcgtgtatatcc

SEQ ID NO: 544 - DNA, 62 bp, synthetic construct
  source 1..62: mol_type = other DNA
gggtatatactttttatttttgataaatatttttttattttttatatatatcgtatataccc

SEQ ID NO: 545 - DNA, 62 bp, synthetic construct
  source 1..62: mol_type = other DNA
gggtatatactttttatttttgataaatgtttttttattttttacatatatcgtatataccc

SEQ ID NO: 546 - DNA, 62 bp, synthetic construct
  source 1..62: mol_type = other DNA
ggatgtacactttttatttttgataaatatttttttattttttatatatatcgtgtacatcc

SEQ ID NO: 547 - DNA, 62 bp, synthetic construct
  source 1..62: mol_type = other DNA
ggatgtacactttttatttttgataaatgtttttttattttttacatatatcgtgtacatcc

SEQ ID NO: 548 - DNA, 64 bp, synthetic construct
  source 1..64: mol_type = other DNA
gtacatatatttttttatttttgataaatatttttttattttttatatatatcaatatatgtac

SEQ ID NO: 549 - DNA, 64 bp, synthetic construct
  source 1..64: mol_type = other DNA
gtacatatatttttttatttttgataaatgtttttttattttttacatatatcaatatatgtac

SEQ ID NO: 550 - DNA, 64 bp, synthetic construct
  source 1..64: mol_type = other DNA
ggtacatatattttttatttttgataaatatttttttattttttatatatatcatatatgtacc

SEQ ID NO: 551 - DNA, 64 bp, synthetic construct
  source 1..64: mol_type = other DNA
ggtacatatattttttatttttgataaatgtttttttattttttacatatatcatatatgtacc

SEQ ID NO: 552 - DNA, 66 bp, synthetic construct
  source 1..66: mol_type = other DNA
cgatcatatatttttttatttttgataaatatttttttattttttatatatatcaatatatgatcg

SEQ ID NO: 553 - DNA, 66 bp, synthetic construct
  source 1..66: mol_type = other DNA
cgatcatatatttttttatttttgataaatgtttttttattttttacatatatcaatatatgatcg

SEQ ID NO: 554 - DNA, 66 bp, synthetic construct
  source 1..66: mol_type = other DNA
cgatcatatatttttttatttttgatgatgaattttttatttttatacatgatcaatatatgatcg

SEQ ID NO: 555 - DNA, 66 bp, synthetic construct
  source 1..66: mol_type = other DNA
cgatcatatatttttttatttttgatgataaattttttatttttatatatgatcaatatatgatcg

SEQ ID NO: 556 - DNA, 68 bp, synthetic construct
  source 1..68: mol_type = other DNA
gtatatactttttatttttgatataaatatataatttttatttttatatatatatatatcgtatatac

SEQ ID NO: 557 - DNA, 68 bp, synthetic construct
  source 1..68: mol_type = other DNA
gtatatactttttatttttgataaatgaatatattttttatttttatatatacatatatcgtatatac

SEQ ID NO: 558 - DNA, 68 bp, synthetic construct
  source 1..68: mol_type = other DNA
ggatatactttttatttttgatataaatatataatttttatttttatatatatatatatcgtatatcc

SEQ ID NO: 559 - DNA, 68 bp, synthetic construct
  source 1..68: mol_type = other DNA
ggatatactttttatttttgataaatgaatatattttttatttttatatatacatatatcgtatatcc

SEQ ID NO: 560 - DNA, 68 bp, synthetic construct
  source 1..68: mol_type = other DNA
ggtgatactttttatttttgatataaatatataatttttatttttatatatatatatatcgtatcacc

SEQ ID NO: 561 - DNA, 68 bp, synthetic construct
  source 1..68: mol_type = other DNA
ggtgatactttttatttttgataaatgaatatattttttatttttatatatacatatatcgtatcacc

SEQ ID NO: 562 - DNA, 68 bp, synthetic construct
  source 1..68: mol_type = other DNA
ggtgatcctttttatttttgatataaatatataatttttatttttatatatatatatatcggatcacc

SEQ ID NO: 563 - DNA, 68 bp, synthetic construct
  source 1..68: mol_type = other DNA
ggtgatcctttttatttttgataaatgaatatattttttatttttatatatacatatatcggatcacc

SEQ ID NO: 564 - DNA, 68 bp, synthetic construct
  source 1..68: mol_type = other DNA
gtatatactttttatttttgatataagtaaatattttttatttttatatatacatatatcgtatatac

SEQ ID NO: 565 - DNA, 68 bp, synthetic construct
  source 1..68: mol_type = other DNA
ggatatactttttatttttgatataagtaaatattttttatttttatatatacatatatcgtatatcc

SEQ ID NO: 566 - DNA, 68 bp, synthetic construct
  source 1..68: mol_type = other DNA
ggtgatactttttatttttgatataagtaaatattttttatttttatatatacatatatcgtatcacc

SEQ ID NO: 567 - DNA, 68 bp, synthetic construct
  source 1..68: mol_type = other DNA
ggtgatcctttttatttttgatataagtaaatattttttatttttatatatacatatatcggatcacc

SEQ ID NO: 568 - DNA, 66 bp, synthetic construct
  source 1..66: mol_type = other DNA
gtatatactttttattttttataaatatatatttttttattttttatatatatatatagtatatac

SEQ ID NO: 569 - DNA, 66 bp, synthetic construct
  source 1..66: mol_type = other DNA
gtatatactttttatttttgatataaatatatttttttattttttatatatatatatcgtatatac

SEQ ID NO: 570 - DNA, 66 bp, synthetic construct
  source 1..66: mol_type = other DNA
gtatatactttttatttttgataaatgaatatatttttattttttatatacatatatcgtatatac

SEQ ID NO: 571 - DNA, 66 bp, synthetic construct
  source 1..66: mol_type = other DNA
ggatatactttttattttttataaatatatatttttttattttttatatatatatatagtatatcc

SEQ ID NO: 572 - DNA, 66 bp, synthetic construct
  source 1..66: mol_type = other DNA
ggatatactttttatttttgatataaatatatttttttattttttatatatatatatcgtatatcc

SEQ ID NO: 573 - DNA, 66 bp, synthetic construct
  source 1..66: mol_type = other DNA
ggatatactttttatttttgataaatgaatatatttttattttttatatacatatatcgtatatcc

SEQ ID NO: 574 - DNA, 66 bp, synthetic construct
  source 1..66: mol_type = other DNA
ggtgatactttttattttttataaatatatatttttttattttttatatatatatatagtatcacc

SEQ ID NO: 575 - DNA, 66 bp, synthetic construct
  source 1..66: mol_type = other DNA
ggtgatactttttatttttgatataaatatatttttttattttttatatatatatatcgtatcacc

SEQ ID NO: 576 - DNA, 66 bp, synthetic construct
  source 1..66: mol_type = other DNA
ggtgatactttttatttttgataaatgaatatatttttattttttatatacatatatcgtatcacc

SEQ ID NO: 577 - DNA, 66 bp, synthetic construct
  source 1..66: mol_type = other DNA
ggtgatcctttttattttttataaatatatatttttttattttttatatatatatataggatcacc

SEQ ID NO: 578 - DNA, 66 bp, synthetic construct
  source 1..66: mol_type = other DNA
ggtgatcctttttatttttgatataaatatatttttttattttttatatatatatatcggatcacc

SEQ ID NO: 579 - DNA, 66 bp, synthetic construct
  source 1..66: mol_type = other DNA
ggtgatcctttttatttttgataaatgaatatatttttattttttatatacatatatcggatcacc

SEQ ID NO: 580 - DNA, 66 bp, synthetic construct
  source 1..66: mol_type = other DNA
gtatatactttttatttttgatatataaatatttttttattttttatatatatatatcgtatatac

SEQ ID NO: 581 - DNA, 66 bp, synthetic construct
  source 1..66: mol_type = other DNA
ggatatactttttatttttgatatataaatatttttttattttttatatatatatatcgtatatcc

SEQ ID NO: 582 - DNA, 66 bp, synthetic construct
  source 1..66: mol_type = other DNA
ggtgatactttttatttttgatatataaatatttttttattttttatatatatatatcgtatcacc

SEQ ID NO: 583 - DNA, 66 bp, synthetic construct
  source 1..66: mol_type = other DNA
ggtgatcctttttatttttgatatataaatatttttttattttttatatatatatatcggatcacc

SEQ ID NO: 584 - DNA, 62 bp, synthetic construct
  source 1..62: mol_type = other DNA
gatacaaaaaaaaaaatatatatatatatataaaaaaaaaaaatatatatatatatagtatc

SEQ ID NO: 585 - DNA, 62 bp, synthetic construct
  source 1..62: mol_type = other DNA
gacacaaaaaaaaaaagatatatatatatataaaaaaaaaaaatatatatatatatcgtgtc

SEQ ID NO: 586 - DNA, 62 bp, synthetic construct
  source 1..62: mol_type = other DNA
gatatacaaaaaaaaaaatatatatatatataaaaaaaaaaaatatatatatatagtatatc

SEQ ID NO: 587 - DNA, 62 bp, synthetic construct
  source 1..62: mol_type = other DNA
gatatataaaaaaaaaaagatatatgtatataaaaaaaaaaaatatacatatatcatatatc

SEQ ID NO: 588 - DNA, 62 bp, synthetic construct
  source 1..62: mol_type = other DNA
gatatacaaaaaaaaaaagatatatatatataaaaaaaaaaaatatatatatatcgtatatc

SEQ ID NO: 589 - DNA, 62 bp, synthetic construct
  source 1..62: mol_type = other DNA
ggtatacaaaaaaaaaaatatatatatatataaaaaaaaaaaatatatatatatagtatacc

SEQ ID NO: 590 - DNA, 62 bp, synthetic construct
  source 1..62: mol_type = other DNA
gatatatcacaaaaaaaaaaatatatatataaaaaaaaaaaatatatatatagtgatatatc

SEQ ID NO: 591 - DNA, 62 bp, synthetic construct
  source 1..62: mol_type = other DNA
gtatatacataaaaaaaaaaagatatatgtaaaaaaaaaaaatacatatatcatgtatatac

SEQ ID NO: 592 - DNA, 62 bp, synthetic construct
  source 1..62: mol_type = other DNA
ggatatacataaaaaaaaaaagatatatgtaaaaaaaaaaaatacatatatcatgtatatcc

SEQ ID NO: 593 - DNA, 62 bp, synthetic construct
  source 1..62: mol_type = other DNA
ggatatacataaaaaaaaaaagatcatgtataaaaaaaaaaaatacatgatcatgtatatcc

SEQ ID NO: 594 - DNA, 62 bp, synthetic construct
  source 1..62: mol_type = other DNA
gggtatatacaaaaaaaaaaatatatatataaaaaaaaaaaatatatatatagtatataccc

SEQ ID NO: 595 - DNA, 68 bp, synthetic construct
  source 1..68: mol_type = other DNA
gtatatacaaaaaaaaaaatatatatatatatataaaaaaaaaaaatatatatatatatagtatatac

SEQ ID NO: 596 - DNA, 68 bp, synthetic construct
  source 1..68: mol_type = other DNA
gtatatacaaaaaaaaaaagatatatatatatataaaaaaaaaaaatatatatatatatcgtatatac

SEQ ID NO: 597 - DNA, 68 bp, synthetic construct
  source 1..68: mol_type = other DNA
ggatatacaaaaaaaaaaatatatatatatatataaaaaaaaaaaatatatatatatatagtatatcc

SEQ ID NO: 598 - DNA, 68 bp, synthetic construct
  source 1..68: mol_type = other DNA
ggatatacaaaaaaaaaaagatatatatatatataaaaaaaaaaaatatatatatatatcgtatatcc

SEQ ID NO: 599 - DNA, 66 bp, synthetic construct
  source 1..66: mol_type = other DNA
gtatatacaaaaaaaaaaatatatatatatataaaaaaaaaaaatatatatatatatagtatatac

SEQ ID NO: 600 - DNA, 66 bp, synthetic construct
  source 1..66: mol_type = other DNA
gtatatacaaaaaaaaaaagatatatatatataaaaaaaaaaaatatatatatatatcgtatatac

SEQ ID NO: 601 - DNA, 66 bp, synthetic construct
  source 1..66: mol_type = other DNA
ggatatacaaaaaaaaaaatatatatatatataaaaaaaaaaaatatatatatatatagtatatcc

SEQ ID NO: 602 - DNA, 66 bp, synthetic construct
  source 1..66: mol_type = other DNA
ggatatacaaaaaaaaaaagatatatatatataaaaaaaaaaaatatatatatatatcgtatatcc

SEQ ID NO: 603 - DNA, 66 bp, synthetic construct
  source 1..66: mol_type = other DNA
gatatatcacaaaaaaaaaaatatatatatataaaaaaaaaaaatatatatatatagtgatatatc

SEQ ID NO: 604 - DNA, 66 bp, synthetic construct
  source 1..66: mol_type = other DNA
ggatatacataaaaaaaaaaagatatatatataaaaaaaaaaaatatatatatatcatgtatatcc

SEQ ID NO: 605 - DNA, 64 bp, synthetic construct
  source 1..64: mol_type = other DNA
gtacatatattaaaaaaaaaaagatatatataaaaaaaaaaaatatatatatcaatatatgtac

SEQ ID NO: 606 - DNA, 64 bp, synthetic construct
  source 1..64: mol_type = other DNA
gatgtatatacaaaaaaaaaaatatatatataaaaaaaaaaaatatatatatagtatatacatc

SEQ ID NO: 607 - DNA, 66 bp, synthetic construct
  source 1..66: mol_type = other DNA
cgatcatatattaaaaaaaaaaagatatatataaaaaaaaaaaatatatatatcaatatatgatcg

SEQ ID NO: 608 - DNA, 66 bp, synthetic construct
  source 1..66: mol_type = other DNA
cgatcatatattaaaaaaaaaaagatatatgtaaaaaaaaaaaatacatatatcaatatatgatcg

SEQ ID NO: 609 - DNA, 62 bp, synthetic construct
  source 1..62: mol_type = other DNA
gatacaaaaaaaaaaatataaatatatatataaaaaaaaaaaatatatatatatatagtatc

SEQ ID NO: 610 - DNA, 62 bp, synthetic construct
  source 1..62: mol_type = other DNA
ggatcaaaaaaaaaaatataaatatatatataaaaaaaaaaaatatatatatatatagatcc

SEQ ID NO: 611 - DNA, 62 bp, synthetic construct
  source 1..62: mol_type = other DNA
gacacaaaaaaaaaaagataaatatatatataaaaaaaaaaaatatatatatatatcgtgtc

SEQ ID NO: 612 - DNA, 62 bp, synthetic construct
  source 1..62: mol_type = other DNA
gacacaaaaaaaaaaagatgatgtatatataaaaaaaaaaaatatatatacatgatcgtgtc

SEQ ID NO: 613 - DNA, 62 bp, synthetic construct
  source 1..62: mol_type = other DNA
gcgtcaaaaaaaaaaagataaatatatatataaaaaaaaaaaatatatatatatatcgacgc

SEQ ID NO: 614 - DNA, 62 bp, synthetic construct
  source 1..62: mol_type = other DNA
gatatacaaaaaaaaaaatataaatatatataaaaaaaaaaaatatatatatatagtatatc

SEQ ID NO: 615 - DNA, 62 bp, synthetic construct
  source 1..62: mol_type = other DNA
gtatatacataaaaaaaaaaagataaatgtaaaaaaaaaaaatacatatatcatgtatatac

SEQ ID NO: 616 - DNA, 62 bp, synthetic construct
  source 1..62: mol_type = other DNA
gtatatacataaaaaaaaaaagatgatatataaaaaaaaaaaatatatgatcatgtatatac

SEQ ID NO: 617 - DNA, 62 bp, synthetic construct
  source 1..62: mol_type = other DNA
ggatatacataaaaaaaaaaagataaatataaaaaaaaaaaatatatatatcatgtatatcc

SEQ ID NO: 618 - DNA, 62 bp, synthetic construct
  source 1..62: mol_type = other DNA
ggatatacataaaaaaaaaaagatgatatataaaaaaaaaaaatatatgatcatgtatatcc

SEQ ID NO: 619 - DNA, 68 bp, synthetic construct
  source 1..68: mol_type = other DNA
gtatatacaaaaaaaaaaatataaatatatatataaaaaaaaaaaatatatatatatatagtatatac

SEQ ID NO: 620 - DNA, 68 bp, synthetic construct
  source 1..68: mol_type = other DNA
gtatatacaaaaaaaaaaagataaatatatatataaaaaaaaaaaatatatatatatatcgtatatac

SEQ ID NO: 621 - DNA, 68 bp, synthetic construct
  source 1..68: mol_type = other DNA
ggatatacaaaaaaaaaaatataaatatatatataaaaaaaaaaaatatatatatatatagtatatcc

SEQ ID NO: 622 - DNA, 68 bp, synthetic construct
  source 1..68: mol_type = other DNA
ggatatacaaaaaaaaaaagataaatatatatataaaaaaaaaaaatatatatatatatcgtatatcc

SEQ ID NO: 623 - DNA, 66 bp, synthetic construct
  source 1..66: mol_type = other DNA
gtatatacaaaaaaaaaaagataaatgtatataaaaaaaaaaaatatatacatatatcgtatatac

SEQ ID NO: 624 - DNA, 66 bp, synthetic construct
  source 1..66: mol_type = other DNA
ggatatacaaaaaaaaaaagataaatgtatataaaaaaaaaaaatatatacatatatcgtatatcc

SEQ ID NO: 625 - DNA, 66 bp, synthetic construct
  source 1..66: mol_type = other DNA
ggtgatacaaaaaaaaaaagatgatgtatatataaaaaaaaaaaatatatacatgatcgtatcacc

SEQ ID NO: 626 - DNA, 68 bp, synthetic construct
  source 1..68: mol_type = other DNA
gatatatcacaaaaaaaaaaatataaatatatataaaaaaaaaaaatatatatatatagtgatatatc

SEQ ID NO: 627 - DNA, 66 bp, synthetic construct
  source 1..66: mol_type = other DNA
gtatatacataaaaaaaaaaagataaatatataaaaaaaaaaaatatatatatatcatgtatatac

SEQ ID NO: 628 - DNA, 66 bp, synthetic construct
  source 1..66: mol_type = other DNA
gtatatacataaaaaaaaaaagatgatatatgtaaaaaaaaaaaacatatatgatcatgtatatac

SEQ ID NO: 629 - DNA, 66 bp, synthetic construct
  source 1..66: mol_type = other DNA
ggatatacataaaaaaaaaaagataaatatataaaaaaaaaaaatatatatatatcatgtatatcc

SEQ ID NO: 630 - DNA, 64 bp, synthetic construct
  source 1..64: mol_type = other DNA
gtacatatattaaaaaaaaaaagataaatataaaaaaaaaaaatatatatatcaatatatgtac

SEQ ID NO: 631 - DNA, 64 bp, synthetic construct
  source 1..64: mol_type = other DNA
gtacatatattaaaaaaaaaaagataaatgtaaaaaaaaaaaatacatatatcaatatatgtac

SEQ ID NO: 632 - DNA, 64 bp, synthetic construct
  source 1..64: mol_type = other DNA
gtacatatattaaaaaaaaaaagatgatatataaaaaaaaaaaatatatgatcaatatatgtac

SEQ ID NO: 633 - DNA, 62 bp, synthetic construct
  source 1..62: mol_type = other DNA
ggatatacataaaaaaaaaaagatgatgaataaaaaaaaaaaatacatgatcatgtatatcc

SEQ ID NO: 634 - DNA, 62 bp, synthetic construct
  source 1..62: mol_type = other DNA
gtatatacataaaaaaaaaaagataaatgttaaaaaaaaaaatacatatatcatgtatatac

SEQ ID NO: 635 - DNA, 62 bp, synthetic construct
  source 1..62: mol_type = other DNA
gatacaaaaaaaaaaagatataaatatataaaaaaaaaaaaaatatatatatatatcgtatc

SEQ ID NO: 636 - DNA, 62 bp, synthetic construct
  source 1..62: mol_type = other DNA
gatacaaaaaaaaaaagatgatataagtactaaaaaaaaaaaagtacatatatgatcgtatc

SEQ ID NO: 637 - DNA, 62 bp, synthetic construct
  source 1..62: mol_type = other DNA
gacacaaaaaaaaaaagataaatgaatatataaaaaaaaaaaatatatacatatatcgtgtc

SEQ ID NO: 638 - DNA, 68 bp, synthetic construct
  source 1..68: mol_type = other DNA
ggatatacaaaaaaaaaaagatataagtaaatataaaaaaaaaaaatatatacatatatcgtatatcc

SEQ ID NO: 639 - DNA, 68 bp, synthetic construct
  source 1..68: mol_type = other DNA
ggatatacaaaaaaaaaaagatgatataagtactaaaaaaaaaaaagtacatatatgatcgtatatcc

SEQ ID NO: 640 - DNA, 68 bp, synthetic construct
  source 1..68: mol_type = other DNA
gtatatacaaaaaaaaaaagatataagtaaatataaaaaaaaaaaatatatacatatatcgtatatac

SEQ ID NO: 641 - DNA, 68 bp, synthetic construct
  source 1..68: mol_type = other DNA
gtatatacaaaaaaaaaaagatgatataagtactaaaaaaaaaaaagtacatatatgatcgtatatac

SEQ ID NO: 642 - DNA, 66 bp, synthetic construct
  source 1..66: mol_type = other DNA
ggatatacaaaaaaaaaaagataaatgaatataaaaaaaaaaaatatatacatatatcgtatatcc

SEQ ID NO: 643 - DNA, 66 bp, synthetic construct
  source 1..66: mol_type = other DNA
gtatatacaaaaaaaaaaagataaatgaatataaaaaaaaaaaatatatacatatatcgtatatac

SEQ ID NO: 644 - DNA, 66 bp, synthetic construct
  source 1..66: mol_type = other DNA
gtatatacaaaaaaaaaaagatgatataagtacaaaaaaaaaaagtacatatatgatcgtatatac

SEQ ID NO: 645 - DNA, 66 bp, synthetic construct
  source 1..66: mol_type = other DNA
gtatatacaaaaaaaaaaatataaatatatattaaaaaaaaaaatatatatatatatagtatatac

SEQ ID NO: 646 - DNA, 70 bp, synthetic construct
  source 1..70: mol_type = other DNA
gtatatacataaaaaaaaaaagatgatgtaaatataaaaaaaaaaaatatatacatgatcatgtatatac

SEQ ID NO: 647 - DNA, 62 bp, synthetic construct
  source 1..62: mol_type = other DNA
gatatacaaaaaaaaaaagataaatatataaaaaaaaaaaaaatatatatatatcgtatatc

SEQ ID NO: 648 - DNA, 62 bp, synthetic construct
  source 1..62: mol_type = other DNA
gtgatacaaaaaaaaaaagataaatatataaaaaaaaaaaaaatatatatatatcgtatcac

SEQ ID NO: 649 - DNA, 62 bp, synthetic construct
  source 1..62: mol_type = other DNA
ggtatacaaaaaaaaaaagataaatatataaaaaaaaaaaaaatatatatatatcgtatacc

SEQ ID NO: 650 - DNA, 66 bp, synthetic construct
  source 1..66: mol_type = other DNA
ggatatacataaaaaaaaaaagataaatgaataaaaaaaaaaaatatacatatatcatgtatatcc

SEQ ID NO: 651 - DNA, 66 bp, synthetic construct
  source 1..66: mol_type = other DNA
gtatatacataaaaaaaaaaagataaatgtattaaaaaaaaaaatatacatatatcatgtatatac

SEQ ID NO: 652 - DNA, 66 bp, synthetic construct
  source 1..66: mol_type = other DNA
gtatatacataaaaaaaaaaagatgataaatgtaaaaaaaaaaaacatatatgatcatgtatatac

SEQ ID NO: 653 - DNA, 62 bp, synthetic construct; identical to SEQ ID NO: 14
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 654 - DNA, 62 bp, synthetic construct; identical to SEQ ID NO: 15
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 655 - DNA, 62 bp, synthetic construct; identical to SEQ ID NO: 16
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 656 - DNA, 62 bp, synthetic construct; identical to SEQ ID NO: 17
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 657 - DNA, 62 bp, synthetic construct; identical to SEQ ID NO: 18
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 658 - DNA, 62 bp, synthetic construct; identical to SEQ ID NO: 19
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 659 - DNA, 62 bp, synthetic construct; identical to SEQ ID NO: 20
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 660 - DNA, 62 bp, synthetic construct; identical to SEQ ID NO: 21
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 661 - DNA, 62 bp, synthetic construct; identical to SEQ ID NO: 22
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 662 - DNA, 62 bp, synthetic construct; identical to SEQ ID NO: 23
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 663 - DNA, 62 bp, synthetic construct; identical to SEQ ID NO: 24
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 664 - DNA, 62 bp, synthetic construct; identical to SEQ ID NO: 25
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 665 - DNA, 62 bp, synthetic construct; identical to SEQ ID NO: 26
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 666 - DNA, 62 bp, synthetic construct; identical to SEQ ID NO: 27
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 667 - DNA, 62 bp, synthetic construct; identical to SEQ ID NO: 28
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 668 - DNA, 62 bp, synthetic construct; identical to SEQ ID NO: 29
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 669 - DNA, 62 bp, synthetic construct; identical to SEQ ID NO: 30
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 670 - DNA, 62 bp, synthetic construct; identical to SEQ ID NO: 31
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 671 - DNA, 62 bp, synthetic construct; identical to SEQ ID NO: 32
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 672 - DNA, 62 bp, synthetic construct; identical to SEQ ID NO: 33
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 673 - DNA, 62 bp, synthetic construct; identical to SEQ ID NO: 34
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 674 - DNA, 62 bp, synthetic construct; identical to SEQ ID NO: 35
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 675 - DNA, 62 bp, synthetic construct; identical to SEQ ID NO: 36
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 676 - DNA, 62 bp, synthetic construct; identical to SEQ ID NO: 37
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 677 - DNA, 62 bp, synthetic construct; identical to SEQ ID NO: 38
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 678 - DNA, 62 bp, synthetic construct; identical to SEQ ID NO: 39
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 679 - DNA, 62 bp, synthetic construct; identical to SEQ ID NO: 40
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 680 - DNA, 62 bp, synthetic construct; identical to SEQ ID NO: 41
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 681 - DNA, 62 bp, synthetic construct; identical to SEQ ID NO: 42
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 682 - DNA, 62 bp, synthetic construct; identical to SEQ ID NO: 43
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 683 - DNA, 62 bp, synthetic construct; identical to SEQ ID NO: 44
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 684 - DNA, 62 bp, synthetic construct; identical to SEQ ID NO: 45
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 685 - DNA, 62 bp, synthetic construct; identical to SEQ ID NO: 46
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 686 - DNA, 62 bp, synthetic construct; identical to SEQ ID NO: 47
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 687 - DNA, 62 bp, synthetic construct; identical to SEQ ID NO: 48
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 688 - DNA, 62 bp, synthetic construct; identical to SEQ ID NO: 49
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 689 - DNA, 62 bp, synthetic construct; identical to SEQ ID NO: 50
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 690 - DNA, 62 bp, synthetic construct; identical to SEQ ID NO: 51
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 691 - DNA, 62 bp, synthetic construct; identical to SEQ ID NO: 52
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 692 - DNA, 62 bp, synthetic construct; identical to SEQ ID NO: 53
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 693 - DNA, 62 bp, synthetic construct; identical to SEQ ID NO: 54
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 694 - DNA, 62 bp, synthetic construct; identical to SEQ ID NO: 55
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 695 - DNA, 62 bp, synthetic construct; identical to SEQ ID NO: 56
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 696 - DNA, 62 bp, synthetic construct; identical to SEQ ID NO: 57
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 697 - DNA, 62 bp, synthetic construct; identical to SEQ ID NO: 58
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 698 - DNA, 62 bp, synthetic construct; identical to SEQ ID NO: 59
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 699 - DNA, 62 bp, synthetic construct; identical to SEQ ID NO: 60
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 700 - DNA, 62 bp, synthetic construct; identical to SEQ ID NO: 61
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 701 - DNA, 62 bp, synthetic construct; identical to SEQ ID NO: 62
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 702 - DNA, 62 bp, synthetic construct; identical to SEQ ID NO: 63
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 703 - DNA, 62 bp, synthetic construct; identical to SEQ ID NO: 64
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 704 - DNA, 62 bp, synthetic construct; identical to SEQ ID NO: 65
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 705 - DNA, 62 bp, synthetic construct; identical to SEQ ID NO: 66
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 706 - DNA, 62 bp, synthetic construct; identical to SEQ ID NO: 67
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 707 - DNA, 62 bp, synthetic construct; identical to SEQ ID NO: 68
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 708 - DNA, 62 bp, synthetic construct; identical to SEQ ID NO: 69
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 709 - DNA, 62 bp, synthetic construct; identical to SEQ ID NO: 70
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 710 - DNA, 62 bp, synthetic construct; identical to SEQ ID NO: 71
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 711 - DNA, 62 bp, synthetic construct; identical to SEQ ID NO: 72
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 712 - DNA, 62 bp, synthetic construct; identical to SEQ ID NO: 73
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 713 - DNA, 62 bp, synthetic construct; identical to SEQ ID NO: 74
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 714 - DNA, 62 bp, synthetic construct; identical to SEQ ID NO: 75
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 715 - DNA, 62 bp, synthetic construct; identical to SEQ ID NO: 76
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 716 - DNA, 62 bp, synthetic construct; identical to SEQ ID NO: 77
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 717 - DNA, 62 bp, synthetic construct; identical to SEQ ID NO: 78
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 718 - DNA, 62 bp, synthetic construct; identical to SEQ ID NO: 79
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 719 - DNA, 62 bp, synthetic construct; identical to SEQ ID NO: 80
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 720 - DNA, 62 bp, synthetic construct; identical to SEQ ID NO: 81
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 721 - DNA, 62 bp, synthetic construct; identical to SEQ ID NO: 82
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 722 - DNA, 62 bp, synthetic construct; identical to SEQ ID NO: 83
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 723 - DNA, 62 bp, synthetic construct; identical to SEQ ID NO: 84
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 724 - DNA, 62 bp, synthetic construct; identical to SEQ ID NO: 85
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 725 - DNA, 62 bp, synthetic construct; identical to SEQ ID NO: 86
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 726 - DNA, 62 bp, synthetic construct; identical to SEQ ID NO: 87
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 727 - DNA, 62 bp, synthetic construct; identical to SEQ ID NO: 88
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 728 - DNA, 62 bp, synthetic construct; identical to SEQ ID NO: 89
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 729 - DNA, 62 bp, synthetic construct; identical to SEQ ID NO: 90
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 730 - DNA, 62 bp, synthetic construct; identical to SEQ ID NO: 91
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 731 - DNA, 68 bp, synthetic construct; identical to SEQ ID NO: 92
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 732 - DNA, 68 bp, synthetic construct; identical to SEQ ID NO: 93
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 733 - DNA, 68 bp, synthetic construct; identical to SEQ ID NO: 94
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 734 - DNA, 68 bp, synthetic construct; identical to SEQ ID NO: 95
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 735 - DNA, 68 bp, synthetic construct; identical to SEQ ID NO: 96
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 736 - DNA, 68 bp, synthetic construct; identical to SEQ ID NO: 97
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 737 - DNA, 68 bp, synthetic construct; identical to SEQ ID NO: 98
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 738 - DNA, 68 bp, synthetic construct; identical to SEQ ID NO: 99
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 739 - DNA, 72 bp, synthetic construct; identical to SEQ ID NO: 100
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Adenine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Adenine phosphorothioate

SEQ ID NO: 740 - DNA, 72 bp, synthetic construct; identical to SEQ ID NO: 101
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 741 - DNA, 72 bp, synthetic construct; identical to SEQ ID NO: 102
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Adenine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 742 - DNA, 72 bp, synthetic construct; identical to SEQ ID NO: 103
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 743 - DNA, 72 bp, synthetic construct; identical to SEQ ID NO: 104
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Adenine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 744 - DNA, 72 bp, synthetic construct; identical to SEQ ID NO: 105
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 745 - DNA, 72 bp, synthetic construct; identical to SEQ ID NO: 106
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 746 - DNA, 66 bp, synthetic construct; identical to SEQ ID NO: 107
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 747 - DNA, 66 bp, synthetic construct; identical to SEQ ID NO: 108
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 748 - DNA, 66 bp, synthetic construct; identical to SEQ ID NO: 109
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 749 - DNA, 66 bp, synthetic construct; identical to SEQ ID NO: 110
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 750 - DNA, 66 bp, synthetic construct; identical to SEQ ID NO: 111
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 751 - DNA, 66 bp, synthetic construct; identical to SEQ ID NO: 112
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 752 - DNA, 66 bp, synthetic construct; identical to SEQ ID NO: 113
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 753 - DNA, 66 bp, synthetic construct; identical to SEQ ID NO: 114
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 754 - DNA, 66 bp, synthetic construct; identical to SEQ ID NO: 115
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 755 - DNA, 66 bp, synthetic construct; identical to SEQ ID NO: 116
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 756 - DNA, 66 bp, synthetic construct; identical to SEQ ID NO: 117
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 757 - DNA, 66 bp, synthetic construct; identical to SEQ ID NO: 118
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 758 - DNA, 70 bp, synthetic construct; identical to SEQ ID NO: 119
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Adenine phosphorothioate
  modified_base 65: mod_base = OTHER; note = Thymine phosphorothioate

SEQ ID NO: 759 - DNA, 70 bp, synthetic construct; identical to SEQ ID NO: 120
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 760 - DNA, 70 bp, synthetic construct; identical to SEQ ID NO: 121
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 761 - DNA, 70 bp, synthetic construct; identical to SEQ ID NO: 122
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 762 - DNA, 70 bp, synthetic construct; identical to SEQ ID NO: 123
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 763 - DNA, 70 bp, synthetic construct; identical to SEQ ID NO: 124
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 764 - DNA, 70 bp, synthetic construct; identical to SEQ ID NO: 125
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 765 - DNA, 70 bp, synthetic construct; identical to SEQ ID NO: 126
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 766 - DNA, 70 bp, synthetic construct; identical to SEQ ID NO: 127
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 767 - DNA, 70 bp, synthetic construct; identical to SEQ ID NO: 128
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 768 - DNA, 70 bp, synthetic construct; identical to SEQ ID NO: 129
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 769 - DNA, 68 bp, synthetic construct; identical to SEQ ID NO: 130
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Adenine phosphorothioate
  modified_base 63: mod_base = OTHER; note = Thymine phosphorothioate
  modified_base 64: mod_base = OTHER; note = Adenine phosphorothioate

SEQ ID NO: 770 - DNA, 68 bp, synthetic construct; identical to SEQ ID NO: 131
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 771 - DNA, 68 bp, synthetic construct; identical to SEQ ID NO: 132
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 772 - DNA, 68 bp, synthetic construct; identical to SEQ ID NO: 133
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 773 - DNA, 68 bp, synthetic construct; identical to SEQ ID NO: 134
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 774 - DNA, 68 bp, synthetic construct; identical to SEQ ID NO: 135
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 775 - DNA, 68 bp, synthetic construct; identical to SEQ ID NO: 136
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 776 - DNA, 68 bp, synthetic construct; identical to SEQ ID NO: 137
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 777 - DNA, 68 bp, synthetic construct; identical to SEQ ID NO: 138
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 778 - DNA, 68 bp, synthetic construct; identical to SEQ ID NO: 139
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 779 - DNA, 68 bp, synthetic construct; identical to SEQ ID NO: 140
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 780 - DNA, 66 bp, synthetic construct; identical to SEQ ID NO: 141
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Adenine phosphorothioate
  modified_base 63: mod_base = OTHER; note = Thymine phosphorothioate

SEQ ID NO: 781 - DNA, 66 bp, synthetic construct; identical to SEQ ID NO: 142
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 782 - DNA, 66 bp, synthetic construct; identical to SEQ ID NO: 143
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 783 - DNA, 66 bp, synthetic construct; identical to SEQ ID NO: 144
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 784 - DNA, 66 bp, synthetic construct; identical to SEQ ID NO: 145
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 785 - DNA, 66 bp, synthetic construct; identical to SEQ ID NO: 146
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 786 - DNA, 66 bp, synthetic construct; identical to SEQ ID NO: 147
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 787 - DNA, 66 bp, synthetic construct; identical to SEQ ID NO: 148
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 788 - DNA, 66 bp, synthetic construct; identical to SEQ ID NO: 149
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 789 - DNA, 66 bp, synthetic construct; identical to SEQ ID NO: 150
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 790 - DNA, 66 bp, synthetic construct; identical to SEQ ID NO: 151
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 791 - DNA, 66 bp, synthetic construct; identical to SEQ ID NO: 152
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 792 - DNA, 66 bp, synthetic construct; identical to SEQ ID NO: 153
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 793 - DNA, 66 bp, synthetic construct; identical to SEQ ID NO: 154
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 794 - DNA, 66 bp, synthetic construct; identical to SEQ ID NO: 155
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 795 - DNA, 66 bp, synthetic construct; identical to SEQ ID NO: 156
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 796 - DNA, 66 bp, synthetic construct; identical to SEQ ID NO: 157
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 797 - DNA, 66 bp, synthetic construct; identical to SEQ ID NO: 158
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 798 - DNA, 66 bp, synthetic construct; identical to SEQ ID NO: 159
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 799 - DNA, 64 bp, synthetic construct; identical to SEQ ID NO: 160
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 800 - DNA, 64 bp, synthetic construct; identical to SEQ ID NO: 161
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 801 - DNA, 64 bp, synthetic construct; identical to SEQ ID NO: 162
  source 1..64: mol_type = other DNA
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Guanosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 802 - DNA, 64 bp, synthetic construct; identical to SEQ ID NO: 163
  source 1..64: mol_type = other DNA
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Guanosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 803 - DNA, 64 bp, synthetic construct; identical to SEQ ID NO: 164
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Guanosine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate
  modified_base 62: mod_base = OTHER; note = Adenine phosphorothioate

SEQ ID NO: 804 - DNA, 64 bp, synthetic construct; identical to SEQ ID NO: 165
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 805 - DNA, 64 bp, synthetic construct; identical to SEQ ID NO: 166
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 806 - DNA, 64 bp, synthetic construct; identical to SEQ ID NO: 167
  source 1..64: mol_type = other DNA
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Guanosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 807 - DNA, 64 bp, synthetic construct; identical to SEQ ID NO: 168
  source 1..64: mol_type = other DNA
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Guanosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 808 - DNA, 66 bp, synthetic construct; identical to SEQ ID NO: 169
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 809 - DNA, 66 bp, synthetic construct; identical to SEQ ID NO: 170
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 810 - DNA, 66 bp, synthetic construct; identical to SEQ ID NO: 171
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 811 - DNA, 66 bp, synthetic construct; identical to SEQ ID NO: 172
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 812 - DNA, 62 bp, synthetic construct; identical to SEQ ID NO: 173
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 813 - DNA, 62 bp, synthetic construct; identical to SEQ ID NO: 174
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 814 - DNA, 62 bp, synthetic construct; identical to SEQ ID NO: 175
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 815 - DNA, 62 bp, synthetic construct; identical to SEQ ID NO: 176
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 816 - DNA, 62 bp, synthetic construct; identical to SEQ ID NO: 177
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 817 - DNA, 62 bp, synthetic construct; identical to SEQ ID NO: 178
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 818 - DNA, 62 bp, synthetic construct; identical to SEQ ID NO: 179
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 819 - DNA, 62 bp, synthetic construct; identical to SEQ ID NO: 180
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 820 - DNA, 62 bp, synthetic construct; identical to SEQ ID NO: 181
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 821 - DNA, 62 bp, synthetic construct; identical to SEQ ID NO: 182
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 822 - DNA, 62 bp, synthetic construct; identical to SEQ ID NO: 183
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 823 - DNA, 62 bp, synthetic construct; identical to SEQ ID NO: 184
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 824 - DNA, 62 bp, synthetic construct; identical to SEQ ID NO: 185
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 825 - DNA, 62 bp, synthetic construct; identical to SEQ ID NO: 186
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 826 - DNA, 62 bp, synthetic construct; identical to SEQ ID NO: 187
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 827 - DNA, 62 bp, synthetic construct; identical to SEQ ID NO: 188
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 828 - DNA, 62 bp, synthetic construct; identical to SEQ ID NO: 189
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 829 - DNA, 62 bp, synthetic construct; identical to SEQ ID NO: 190
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 830 - DNA, 62 bp, synthetic construct; identical to SEQ ID NO: 191
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 831 - DNA, 62 bp, synthetic construct; identical to SEQ ID NO: 192
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 832 - DNA, 62 bp, synthetic construct; identical to SEQ ID NO: 193
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 833 - DNA, 62 bp, synthetic construct; identical to SEQ ID NO: 194
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 834 - DNA, 62 bp, synthetic construct; identical to SEQ ID NO: 195
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 835 - DNA, 62 bp, synthetic construct; identical to SEQ ID NO: 196
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 836 - DNA, 62 bp, synthetic construct; identical to SEQ ID NO: 197
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 837 - DNA, 62 bp, synthetic construct; identical to SEQ ID NO: 198
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 838 - DNA, 62 bp, synthetic construct; identical to SEQ ID NO: 199
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 839 - DNA, 62 bp, synthetic construct; identical to SEQ ID NO: 200
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 840 - DNA, 62 bp, synthetic construct; identical to SEQ ID NO: 201
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 841 - DNA, 62 bp, synthetic construct; identical to SEQ ID NO: 202
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 842 - DNA, 62 bp, synthetic construct; identical to SEQ ID NO: 203
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 843 - DNA, 62 bp, synthetic construct; identical to SEQ ID NO: 204
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 844 - DNA, 62 bp, synthetic construct; identical to SEQ ID NO: 205
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 845 - DNA, 62 bp, synthetic construct; identical to SEQ ID NO: 206
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 846 - DNA, 62 bp, synthetic construct; identical to SEQ ID NO: 207
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 847 - DNA, 62 bp, synthetic construct; identical to SEQ ID NO: 208
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 848 - DNA, 62 bp, synthetic construct; identical to SEQ ID NO: 209
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 849 - DNA, 62 bp, synthetic construct; identical to SEQ ID NO: 210
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 850 - DNA, 62 bp, synthetic construct; identical to SEQ ID NO: 211
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 851 - DNA, 62 bp, synthetic construct; identical to SEQ ID NO: 212
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 852 - DNA, 62 bp, synthetic construct; identical to SEQ ID NO: 213
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 853 - DNA, 62 bp, synthetic construct; identical to SEQ ID NO: 214
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 854 - DNA, 62 bp, synthetic construct; identical to SEQ ID NO: 215
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 855 - DNA, 62 bp, synthetic construct; identical to SEQ ID NO: 216
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 856 - DNA, 62 bp, synthetic construct; identical to SEQ ID NO: 217
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 857 - DNA, 62 bp, synthetic construct; identical to SEQ ID NO: 218
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 858 - DNA, 62 bp, synthetic construct; identical to SEQ ID NO: 219
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 859 - DNA, 62 bp, synthetic construct; identical to SEQ ID NO: 220
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 860 - DNA, 62 bp, synthetic construct; identical to SEQ ID NO: 221
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 861 - DNA, 62 bp, synthetic construct; identical to SEQ ID NO: 222
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 862 - DNA, 62 bp, synthetic construct; identical to SEQ ID NO: 223
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 863 - DNA, 62 bp, synthetic construct; identical to SEQ ID NO: 224
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 864 - DNA, 62 bp, synthetic construct; identical to SEQ ID NO: 225
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 865 - DNA, 62 bp, synthetic construct; identical to SEQ ID NO: 226
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 866 - DNA, 62 bp, synthetic construct; identical to SEQ ID NO: 227
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 867 - DNA, 62 bp, synthetic construct; identical to SEQ ID NO: 228
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 868 - DNA, 62 bp, synthetic construct; identical to SEQ ID NO: 229
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 869 - DNA, 62 bp, synthetic construct; identical to SEQ ID NO: 230
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 870 - DNA, 62 bp, synthetic construct; identical to SEQ ID NO: 231
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 871 - DNA, 62 bp, synthetic construct; identical to SEQ ID NO: 232
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 872 - DNA, 62 bp, synthetic construct; identical to SEQ ID NO: 233
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 873 - DNA, 62 bp, synthetic construct; identical to SEQ ID NO: 234
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 874 - DNA, 62 bp, synthetic construct; identical to SEQ ID NO: 235
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 875 - DNA, 62 bp, synthetic construct; identical to SEQ ID NO: 236
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 876 - DNA, 62 bp, synthetic construct; identical to SEQ ID NO: 237
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 877 - DNA, 62 bp, synthetic construct; identical to SEQ ID NO: 238
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 878 - DNA, 62 bp, synthetic construct; identical to SEQ ID NO: 239
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 879 - DNA, 62 bp, synthetic construct; identical to SEQ ID NO: 240
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 880 - DNA, 62 bp, synthetic construct; identical to SEQ ID NO: 241
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 881 - DNA, 62 bp, synthetic construct; identical to SEQ ID NO: 242
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 882 - DNA, 62 bp, synthetic construct; identical to SEQ ID NO: 243
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 883 - DNA, 62 bp, synthetic construct; identical to SEQ ID NO: 244
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 884 - DNA, 62 bp, synthetic construct; identical to SEQ ID NO: 245
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 885 - DNA, 62 bp, synthetic construct; identical to SEQ ID NO: 246
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 886 - DNA, 62 bp, synthetic construct; identical to SEQ ID NO: 247
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 887 - DNA, 62 bp, synthetic construct; identical to SEQ ID NO: 248
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 888 - DNA, 62 bp, synthetic construct; identical to SEQ ID NO: 249
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 889 - DNA, 62 bp, synthetic construct; identical to SEQ ID NO: 250
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 890 - DNA, 62 bp, synthetic construct; identical to SEQ ID NO: 251
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 891 - DNA, 62 bp, synthetic construct; identical to SEQ ID NO: 252
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 892 - DNA, 62 bp, synthetic construct; identical to SEQ ID NO: 253
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 893 - DNA, 62 bp, synthetic construct; identical to SEQ ID NO: 254
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 894 - DNA, 62 bp, synthetic construct; identical to SEQ ID NO: 255
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 895 - DNA, 62 bp, synthetic construct; identical to SEQ ID NO: 256
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 896 - DNA, 62 bp, synthetic construct; identical to SEQ ID NO: 257
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 897 - DNA, 62 bp, synthetic construct; identical to SEQ ID NO: 258
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 898 - DNA, 62 bp, synthetic construct; identical to SEQ ID NO: 259
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 899 - DNA, 62 bp, synthetic construct; identical to SEQ ID NO: 260
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 900 - DNA, 62 bp, synthetic construct; identical to SEQ ID NO: 261
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 901 - DNA, 62 bp, synthetic construct; identical to SEQ ID NO: 262
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 902 - DNA, 62 bp, synthetic construct; identical to SEQ ID NO: 263
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 903 - DNA, 62 bp, synthetic construct; identical to SEQ ID NO: 264
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 904 - DNA, 62 bp, synthetic construct; identical to SEQ ID NO: 265
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 905 - DNA, 62 bp, synthetic construct; identical to SEQ ID NO: 266
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 906 - DNA, 68 bp, synthetic construct; identical to SEQ ID NO: 267
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 907 - DNA, 68 bp, synthetic construct; identical to SEQ ID NO: 268
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 908 - DNA, 68 bp, synthetic construct; identical to SEQ ID NO: 269
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 909 - DNA, 68 bp, synthetic construct; identical to SEQ ID NO: 270
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 910 - DNA, 68 bp, synthetic construct; identical to SEQ ID NO: 271
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 911 - DNA, 68 bp, synthetic construct; identical to SEQ ID NO: 272
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 912 - DNA, 68 bp, synthetic construct; identical to SEQ ID NO: 273
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 913 - DNA, 68 bp, synthetic construct; identical to SEQ ID NO: 274
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 914 - DNA, 68 bp, synthetic construct; identical to SEQ ID NO: 275
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 915 - DNA, 68 bp, synthetic construct; identical to SEQ ID NO: 276
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 916 - DNA, 68 bp, synthetic construct; identical to SEQ ID NO: 277
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 917 - DNA, 68 bp, synthetic construct; identical to SEQ ID NO: 278
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 918 - DNA, 68 bp, synthetic construct; identical to SEQ ID NO: 279
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 919 - DNA, 68 bp, synthetic construct; identical to SEQ ID NO: 280
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 920 - DNA, 68 bp, synthetic construct; identical to SEQ ID NO: 281
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 921 - DNA, 68 bp, synthetic construct; identical to SEQ ID NO: 282
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 922 - DNA, 68 bp, synthetic construct; identical to SEQ ID NO: 283
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 923 - DNA, 68 bp, synthetic construct; identical to SEQ ID NO: 284
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 924 - DNA, 68 bp, synthetic construct; identical to SEQ ID NO: 285
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 925 - DNA, 68 bp, synthetic construct; identical to SEQ ID NO: 286
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 926 - DNA, 72 bp, synthetic construct; identical to SEQ ID NO: 287
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Adenine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Adenine phosphorothioate

SEQ ID NO: 927 - DNA, 72 bp, synthetic construct; identical to SEQ ID NO: 288
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 928 - DNA, 72 bp, synthetic construct; identical to SEQ ID NO: 289
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 929 - DNA, 72 bp, synthetic construct; identical to SEQ ID NO: 290
  source 1..72: mol_type = other DNA
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 930 - DNA, 72 bp, synthetic construct; identical to SEQ ID NO: 291
  source 1..72: mol_type = other DNA
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 931 - DNA, 72 bp, synthetic construct; identical to SEQ ID NO: 292
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Adenine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 932 - DNA, 72 bp, synthetic construct; identical to SEQ ID NO: 293
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 933 - DNA, 72 bp, synthetic construct; identical to SEQ ID NO: 294
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 934 - DNA, 72 bp, synthetic construct; identical to SEQ ID NO: 295
  source 1..72: mol_type = other DNA
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 935 - DNA, 72 bp, synthetic construct; identical to SEQ ID NO: 296
  source 1..72: mol_type = other DNA
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 936 - DNA, 72 bp, synthetic construct; identical to SEQ ID NO: 297
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Adenine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 937 - DNA, 72 bp, synthetic construct; identical to SEQ ID NO: 298
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 938 - DNA, 72 bp, synthetic construct; identical to SEQ ID NO: 299
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 939 - DNA, 72 bp, synthetic construct; identical to SEQ ID NO: 300
  source 1..72: mol_type = other DNA
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 940 - DNA, 72 bp, synthetic construct; identical to SEQ ID NO: 301
  source 1..72: mol_type = other DNA
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 941 - DNA, 72 bp, synthetic construct; identical to SEQ ID NO: 302
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 942 - DNA, 72 bp, synthetic construct; identical to SEQ ID NO: 303
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 943 - DNA, 72 bp, synthetic construct; identical to SEQ ID NO: 304
  source 1..72: mol_type = other DNA
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 944 - DNA, 72 bp, synthetic construct; identical to SEQ ID NO: 305
  source 1..72: mol_type = other DNA
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 945 - DNA, 66 bp, synthetic construct; identical to SEQ ID NO: 306
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 946 - DNA, 66 bp, synthetic construct; identical to SEQ ID NO: 307
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 947 - DNA, 66 bp, synthetic construct; identical to SEQ ID NO: 308
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 948 - DNA, 66 bp, synthetic construct; identical to SEQ ID NO: 309
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 949 - DNA, 66 bp, synthetic construct; identical to SEQ ID NO: 310
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 950 - DNA, 66 bp, synthetic construct; identical to SEQ ID NO: 311
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 951 - DNA, 66 bp, synthetic construct; identical to SEQ ID NO: 312
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 952 - DNA, 66 bp, synthetic construct; identical to SEQ ID NO: 313
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 953 - DNA, 66 bp, synthetic construct; identical to SEQ ID NO: 314
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 954 - DNA, 66 bp, synthetic construct; identical to SEQ ID NO: 315
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 955 - DNA, 66 bp, synthetic construct; identical to SEQ ID NO: 316
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 956 - DNA, 66 bp, synthetic construct; identical to SEQ ID NO: 317
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 957 - DNA, 66 bp, synthetic construct; identical to SEQ ID NO: 318
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 958 - DNA, 66 bp, synthetic construct; identical to SEQ ID NO: 319
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 959 - DNA, 66 bp, synthetic construct; identical to SEQ ID NO: 320
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 960 - DNA, 66 bp, synthetic construct; identical to SEQ ID NO: 321
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 961 - DNA, 70 bp, synthetic construct; identical to SEQ ID NO: 322
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 962 - DNA, 70 bp, synthetic construct; identical to SEQ ID NO: 323
  source 1..70: mol_type = other DNA
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 963 - DNA, 70 bp, synthetic construct; identical to SEQ ID NO: 324
  source 1..70: mol_type = other DNA
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 964 - DNA, 70 bp, synthetic construct; identical to SEQ ID NO: 325
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 965 - DNA, 70 bp, synthetic construct; identical to SEQ ID NO: 326
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 966 - DNA, 70 bp, synthetic construct; identical to SEQ ID NO: 327
  source 1..70: mol_type = other DNA
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 967 - DNA, 70 bp, synthetic construct; identical to SEQ ID NO: 328
  source 1..70: mol_type = other DNA
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 968 - DNA, 70 bp, synthetic construct; identical to SEQ ID NO: 329
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 969 - DNA, 70 bp, synthetic construct; identical to SEQ ID NO: 330
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 970 - DNA, 70 bp, synthetic construct; identical to SEQ ID NO: 331
  source 1..70: mol_type = other DNA
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 971 - DNA, 70 bp, synthetic construct; identical to SEQ ID NO: 332
  source 1..70: mol_type = other DNA
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 972 - DNA, 70 bp, synthetic construct; identical to SEQ ID NO: 333
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 973 - DNA, 70 bp, synthetic construct; identical to SEQ ID NO: 334
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 974 - DNA, 70 bp, synthetic construct; identical to SEQ ID NO: 335
  source 1..70: mol_type = other DNA
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 975 - DNA, 70 bp, synthetic construct; identical to SEQ ID NO: 336
  source 1..70: mol_type = other DNA
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 976 - DNA, 68 bp, synthetic construct; identical to SEQ ID NO: 337
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Adenine phosphorothioate
  modified_base 63: mod_base = OTHER; note = Thymine phosphorothioate
  modified_base 64: mod_base = OTHER; note = Adenine phosphorothioate

SEQ ID NO: 977 - DNA, 68 bp, synthetic construct; identical to SEQ ID NO: 338
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 978 - DNA, 68 bp, synthetic construct; identical to SEQ ID NO: 339
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 979 - DNA, 68 bp, synthetic construct; identical to SEQ ID NO: 340
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 980 - DNA, 68 bp, synthetic construct; identical to SEQ ID NO: 341
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 981 - DNA, 68 bp, synthetic construct; identical to SEQ ID NO: 342
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 982 - DNA, 68 bp, synthetic construct; identical to SEQ ID NO: 343
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 983 - DNA, 68 bp, synthetic construct; identical to SEQ ID NO: 344
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 984 - DNA, 68 bp, synthetic construct; identical to SEQ ID NO: 345
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 985 - DNA, 68 bp, synthetic construct; identical to SEQ ID NO: 346
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 986 - DNA, 68 bp, synthetic construct; identical to SEQ ID NO: 347
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 987 - DNA, 68 bp, synthetic construct; identical to SEQ ID NO: 348
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 988 - DNA, 68 bp, synthetic construct; identical to SEQ ID NO: 349
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 989 - DNA, 68 bp, synthetic construct; identical to SEQ ID NO: 350
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 990 - DNA, 68 bp, synthetic construct; identical to SEQ ID NO: 351
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 991 - DNA, 68 bp, synthetic construct; identical to SEQ ID NO: 352
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 992 - DNA, 68 bp, synthetic construct; identical to SEQ ID NO: 353
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 993 - DNA, 68 bp, synthetic construct; identical to SEQ ID NO: 354
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 994 - DNA, 66 bp, synthetic construct; identical to SEQ ID NO: 355
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 995 - DNA, 66 bp, synthetic construct; identical to SEQ ID NO: 356
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 996 - DNA, 66 bp, synthetic construct; identical to SEQ ID NO: 357
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 997 - DNA, 66 bp, synthetic construct; identical to SEQ ID NO: 358
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 998 - DNA, 66 bp, synthetic construct; identical to SEQ ID NO: 359
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 999 - DNA, 66 bp, synthetic construct; identical to SEQ ID NO: 360
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1000 - DNA, 66 bp, synthetic construct; identical to SEQ ID NO: 361
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1001 - DNA, 66 bp, synthetic construct; identical to SEQ ID NO: 362
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1002 - DNA, 66 bp, synthetic construct; identical to SEQ ID NO: 363
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1003 - DNA, 66 bp, synthetic construct; identical to SEQ ID NO: 364
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1004 - DNA, 66 bp, synthetic construct; identical to SEQ ID NO: 365
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1005 - DNA, 66 bp, synthetic construct; identical to SEQ ID NO: 366
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1006 - DNA, 66 bp, synthetic construct; identical to SEQ ID NO: 367
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1007 - DNA, 66 bp, synthetic construct; identical to SEQ ID NO: 368
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1008 - DNA, 66 bp, synthetic construct; identical to SEQ ID NO: 369
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1009 - DNA, 64 bp, synthetic construct; identical to SEQ ID NO: 370
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1010 - DNA, 64 bp, synthetic construct; identical to SEQ ID NO: 371
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1011 - DNA, 64 bp, synthetic construct; identical to SEQ ID NO: 372
  source 1..64: mol_type = other DNA
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Guanosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1012 - DNA, 64 bp, synthetic construct; identical to SEQ ID NO: 373
  source 1..64: mol_type = other DNA
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Guanosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1013 - DNA, 64 bp, synthetic construct; identical to SEQ ID NO: 374
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 1014 - DNA, 64 bp, synthetic construct; identical to SEQ ID NO: 375
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 1015 - DNA, 64 bp, synthetic construct; identical to SEQ ID NO: 376
  source 1..64: mol_type = other DNA
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Guanosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 1016 - DNA, 64 bp, synthetic construct; identical to SEQ ID NO: 377
  source 1..64: mol_type = other DNA
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Guanosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 1017 - DNA, 66 bp, synthetic construct; identical to SEQ ID NO: 378
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1018 - DNA, 66 bp, synthetic construct; identical to SEQ ID NO: 379
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1019 - DNA, 66 bp, synthetic construct; identical to SEQ ID NO: 380
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1020 - DNA, 66 bp, synthetic construct; identical to SEQ ID NO: 381
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1021 - DNA, 68 bp, synthetic construct; identical to SEQ ID NO: 382
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1022 - DNA, 68 bp, synthetic construct; identical to SEQ ID NO: 383
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1023 - DNA, 68 bp, synthetic construct; identical to SEQ ID NO: 384
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1024 - DNA, 68 bp, synthetic construct; identical to SEQ ID NO: 385
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1025 - DNA, 68 bp, synthetic construct; identical to SEQ ID NO: 386
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1026 - DNA, 68 bp, synthetic construct; identical to SEQ ID NO: 387
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1027 - DNA, 68 bp, synthetic construct; identical to SEQ ID NO: 388
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 1028 - DNA, 68 bp, synthetic construct; identical to SEQ ID NO: 389
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 1029 - DNA, 72 bp, synthetic construct; identical to SEQ ID NO: 390
  source 1..72: mol_type = other DNA
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1030 - DNA, 72 bp, synthetic construct; identical to SEQ ID NO: 391
  source 1..72: mol_type = other DNA
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1031 - DNA, 72 bp, synthetic construct; identical to SEQ ID NO: 392
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1032 - DNA, 72 bp, synthetic construct; identical to SEQ ID NO: 393
  source 1..72: mol_type = other DNA
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1033 - DNA, 72 bp, synthetic construct; identical to SEQ ID NO: 394
  source 1..72: mol_type = other DNA
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1034 - DNA, 72 bp, synthetic construct; identical to SEQ ID NO: 395
  source 1..72: mol_type = other DNA
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1035 - DNA, 72 bp, synthetic construct; identical to SEQ ID NO: 396
  source 1..72: mol_type = other DNA
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1036 - DNA, 72 bp, synthetic construct; identical to SEQ ID NO: 397
  source 1..72: mol_type = other DNA
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 1037 - DNA, 72 bp, synthetic construct; identical to SEQ ID NO: 398
  source 1..72: mol_type = other DNA
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 1038 - DNA, 66 bp, synthetic construct; identical to SEQ ID NO: 399
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1039 - DNA, 66 bp, synthetic construct; identical to SEQ ID NO: 400
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1040 - DNA, 66 bp, synthetic construct; identical to SEQ ID NO: 401
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1041 - DNA, 66 bp, synthetic construct; identical to SEQ ID NO: 402
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1042 - DNA, 66 bp, synthetic construct; identical to SEQ ID NO: 403
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1043 - DNA, 66 bp, synthetic construct; identical to SEQ ID NO: 404
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1044 - DNA, 66 bp, synthetic construct; identical to SEQ ID NO: 405
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1045 - DNA, 66 bp, synthetic construct; identical to SEQ ID NO: 406
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1046 - DNA, 70 bp, synthetic construct; identical to SEQ ID NO: 407
  source 1..70: mol_type = other DNA
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1047 - DNA, 70 bp, synthetic construct; identical to SEQ ID NO: 408
  source 1..70: mol_type = other DNA
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1048 - DNA, 70 bp, synthetic construct; identical to SEQ ID NO: 409
  source 1..70: mol_type = other DNA
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1049 - DNA, 70 bp, synthetic construct; identical to SEQ ID NO: 410
  source 1..70: mol_type = other DNA
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1050 - DNA, 70 bp, synthetic construct; identical to SEQ ID NO: 411
  source 1..70: mol_type = other DNA
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1051 - DNA, 70 bp, synthetic construct; identical to SEQ ID NO: 412
  source 1..70: mol_type = other DNA
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1052 - DNA, 70 bp, synthetic construct; identical to SEQ ID NO: 413
  source 1..70: mol_type = other DNA
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 1053 - DNA, 70 bp, synthetic construct; identical to SEQ ID NO: 414
  source 1..70: mol_type = other DNA
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 1054 - DNA, 68 bp, synthetic construct; identical to SEQ ID NO: 415
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1055 - DNA, 68 bp, synthetic construct; identical to SEQ ID NO: 416
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1056 - DNA, 68 bp, synthetic construct; identical to SEQ ID NO: 417
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1057 - DNA, 68 bp, synthetic construct; identical to SEQ ID NO: 418
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1058 - DNA, 68 bp, synthetic construct; identical to SEQ ID NO: 419
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1059 - DNA, 68 bp, synthetic construct; identical to SEQ ID NO: 420
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1060 - DNA, 68 bp, synthetic construct; identical to SEQ ID NO: 421
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1061 - DNA, 66 bp, synthetic construct; identical to SEQ ID NO: 422
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1062 - DNA, 66 bp, synthetic construct; identical to SEQ ID NO: 423
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1063 - DNA, 66 bp, synthetic construct; identical to SEQ ID NO: 424
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1064 - DNA, 66 bp, synthetic construct; identical to SEQ ID NO: 425
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1065 - DNA, 66 bp, synthetic construct; identical to SEQ ID NO: 426
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1066 - DNA, 66 bp, synthetic construct; identical to SEQ ID NO: 427
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1067 - DNA, 62 bp, synthetic construct; identical to SEQ ID NO: 428
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1068 - DNA, 62 bp, synthetic construct; identical to SEQ ID NO: 429
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1069 - DNA, 62 bp, synthetic construct; identical to SEQ ID NO: 430
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 1070 - DNA, 62 bp, synthetic construct; identical to SEQ ID NO: 431
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 1071 - DNA, 62 bp, synthetic construct; identical to SEQ ID NO: 432
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1072 - DNA, 62 bp, synthetic construct; identical to SEQ ID NO: 433
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1073 - DNA, 62 bp, synthetic construct; identical to SEQ ID NO: 434
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 1074 - DNA, 62 bp, synthetic construct; identical to SEQ ID NO: 435
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 1075 - DNA, 62 bp, synthetic construct; identical to SEQ ID NO: 436
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1076 - DNA, 62 bp, synthetic construct; identical to SEQ ID NO: 437
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1077 - DNA, 62 bp, synthetic construct; identical to SEQ ID NO: 438
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1078 - DNA, 62 bp, synthetic construct; identical to SEQ ID NO: 439
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1079 - DNA, 62 bp, synthetic construct; identical to SEQ ID NO: 440
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1080 - DNA, 62 bp, synthetic construct; identical to SEQ ID NO: 441
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1081 - DNA, 62 bp, synthetic construct; identical to SEQ ID NO: 442
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 1082 - DNA, 62 bp, synthetic construct; identical to SEQ ID NO: 443
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 1083 - DNA, 62 bp, synthetic construct; identical to SEQ ID NO: 444
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1084 - DNA, 62 bp, synthetic construct; identical to SEQ ID NO: 445
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1085 - DNA, 62 bp, synthetic construct; identical to SEQ ID NO: 446
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1086 - DNA, 62 bp, synthetic construct; identical to SEQ ID NO: 447
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1087 - DNA, 62 bp, synthetic construct; identical to SEQ ID NO: 448
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 1088 - DNA, 62 bp, synthetic construct; identical to SEQ ID NO: 449
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 1089 - DNA, 62 bp, synthetic construct; identical to SEQ ID NO: 450
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1090 - DNA, 62 bp, synthetic construct; identical to SEQ ID NO: 451
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1091 - DNA, 62 bp, synthetic construct; identical to SEQ ID NO: 452
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1092 - DNA, 62 bp, synthetic construct; identical to SEQ ID NO: 453
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1093 - DNA, 62 bp, synthetic construct; identical to SEQ ID NO: 454
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1094 - DNA, 62 bp, synthetic construct; identical to SEQ ID NO: 455
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1095 - DNA, 62 bp, synthetic construct; identical to SEQ ID NO: 456
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1096 - DNA, 62 bp, synthetic construct; identical to SEQ ID NO: 457
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1097 - DNA, 62 bp, synthetic construct; identical to SEQ ID NO: 458
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1098 - DNA, 62 bp, synthetic construct; identical to SEQ ID NO: 459
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1099 - DNA, 62 bp, synthetic construct; identical to SEQ ID NO: 460
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 1100 - DNA, 62 bp, synthetic construct; identical to SEQ ID NO: 461
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 1101 - DNA, 62 bp, synthetic construct; identical to SEQ ID NO: 462
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 1102 - DNA, 62 bp, synthetic construct; identical to SEQ ID NO: 463
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1103 - DNA, 62 bp, synthetic construct; identical to SEQ ID NO: 464
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1104 - DNA, 62 bp, synthetic construct; identical to SEQ ID NO: 465
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1105 - DNA, 62 bp, synthetic construct; identical to SEQ ID NO: 466
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 1106 - DNA, 62 bp, synthetic construct; identical to SEQ ID NO: 467
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 1107 - DNA, 62 bp, synthetic construct; identical to SEQ ID NO: 468
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 1108 - DNA, 72 bp, synthetic construct; identical to SEQ ID NO: 469
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1109 - DNA, 72 bp, synthetic construct; identical to SEQ ID NO: 470
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1110 - DNA, 72 bp, synthetic construct; identical to SEQ ID NO: 471
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1111 - DNA, 72 bp, synthetic construct; identical to SEQ ID NO: 472
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1112 - DNA, 72 bp, synthetic construct; identical to SEQ ID NO: 473
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1113 - DNA, 72 bp, synthetic construct; identical to SEQ ID NO: 474
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1114 - DNA, 72 bp, synthetic construct; identical to SEQ ID NO: 475
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1115 - DNA, 72 bp, synthetic construct; identical to SEQ ID NO: 476
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 1116 - DNA, 72 bp, synthetic construct; identical to SEQ ID NO: 477
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 1117 - DNA, 72 bp, synthetic construct; identical to SEQ ID NO: 478
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 1118 - DNA, 62 bp, synthetic construct; identical to SEQ ID NO: 479
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1119 - DNA, 62 bp, synthetic construct; identical to SEQ ID NO: 480
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1120 - DNA, 62 bp, synthetic construct; identical to SEQ ID NO: 481
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1121 - DNA, 62 bp, synthetic construct; identical to SEQ ID NO: 482
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1122 - DNA, 62 bp, synthetic construct; identical to SEQ ID NO: 483
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1123 - DNA, 62 bp, synthetic construct; identical to SEQ ID NO: 484
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1124 - DNA, 62 bp, synthetic construct; identical to SEQ ID NO: 485
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1125 - DNA, 62 bp, synthetic construct; identical to SEQ ID NO: 486
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1126 - DNA, 62 bp, synthetic construct; identical to SEQ ID NO: 487
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1127 - DNA, 62 bp, synthetic construct; identical to SEQ ID NO: 488
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1128 - DNA, 62 bp, synthetic construct; identical to SEQ ID NO: 489
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1129 - DNA, 62 bp, synthetic construct; identical to SEQ ID NO: 490
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1130 - DNA, 62 bp, synthetic construct; identical to SEQ ID NO: 491
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 1131 - DNA, 62 bp, synthetic construct; identical to SEQ ID NO: 492
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 1132 - DNA, 62 bp, synthetic construct; identical to SEQ ID NO: 493
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 1133 - DNA, 62 bp, synthetic construct; identical to SEQ ID NO: 494
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 1134 - DNA, 70 bp, synthetic construct; identical to SEQ ID NO: 495
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Adenine phosphorothioate
  modified_base 65: mod_base = OTHER; note = Thymine phosphorothioate

SEQ ID NO: 1135 - DNA, 70 bp, synthetic construct; identical to SEQ ID NO: 496
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1136 - DNA, 70 bp, synthetic construct; identical to SEQ ID NO: 497
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1137 - DNA, 70 bp, synthetic construct; identical to SEQ ID NO: 498
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1138 - DNA, 70 bp, synthetic construct; identical to SEQ ID NO: 499
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1139 - DNA, 70 bp, synthetic construct; identical to SEQ ID NO: 500
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1140 - DNA, 70 bp, synthetic construct; identical to SEQ ID NO: 501
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1141 - DNA, 70 bp, synthetic construct; identical to SEQ ID NO: 502
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 1142 - DNA, 70 bp, synthetic construct; identical to SEQ ID NO: 503
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1143 - DNA, 70 bp, synthetic construct; identical to SEQ ID NO: 504
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1144 - DNA, 70 bp, synthetic construct; identical to SEQ ID NO: 505
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1145 - DNA, 70 bp, synthetic construct; identical to SEQ ID NO: 506
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 1146 - DNA, 70 bp, synthetic construct; identical to SEQ ID NO: 507
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 1147 - DNA, 70 bp, synthetic construct; identical to SEQ ID NO: 508
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 1148 - DNA, 62 bp, synthetic construct; identical to SEQ ID NO: 509
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1149 - DNA, 62 bp, synthetic construct; identical to SEQ ID NO: 510
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1150 - DNA, 62 bp, synthetic construct; identical to SEQ ID NO: 511
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 1151 - DNA, 62 bp, synthetic construct; identical to SEQ ID NO: 512
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1152 - DNA, 68 bp, synthetic construct; identical to SEQ ID NO: 513
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1153 - DNA, 68 bp, synthetic construct; identical to SEQ ID NO: 514
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1154 - DNA, 68 bp, synthetic construct; identical to SEQ ID NO: 515
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1155 - DNA, 68 bp, synthetic construct; identical to SEQ ID NO: 516
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1156 - DNA, 62 bp, synthetic construct; identical to SEQ ID NO: 517
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1157 - DNA, 62 bp, synthetic construct; identical to SEQ ID NO: 518
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1158 - DNA, 62 bp, synthetic construct; identical to SEQ ID NO: 519
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1159 - DNA, 62 bp, synthetic construct; identical to SEQ ID NO: 520
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1160 - DNA, 62 bp, synthetic construct; identical to SEQ ID NO: 521
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1161 - DNA, 62 bp, synthetic construct; identical to SEQ ID NO: 522
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1162 - DNA, 62 bp, synthetic construct; identical to SEQ ID NO: 523
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1163 - DNA, 62 bp, synthetic construct; identical to SEQ ID NO: 524
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1164 - DNA, 62 bp, synthetic construct; identical to SEQ ID NO: 525
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1165 - DNA, 62 bp, synthetic construct; identical to SEQ ID NO: 526
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1166 - DNA, 66 bp, synthetic construct; identical to SEQ ID NO: 527
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1167 - DNA, 66 bp, synthetic construct; identical to SEQ ID NO: 528
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1168 - DNA, 66 bp, synthetic construct; identical to SEQ ID NO: 529
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1169 - DNA, 66 bp, synthetic construct; identical to SEQ ID NO: 530
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1170 - DNA, 66 bp, synthetic construct; identical to SEQ ID NO: 531
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1171 - DNA, 66 bp, synthetic construct; identical to SEQ ID NO: 532
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1172 - DNA, 66 bp, synthetic construct; identical to SEQ ID NO: 533
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1173 - DNA, 66 bp, synthetic construct; identical to SEQ ID NO: 534
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1174 - DNA, 66 bp, synthetic construct; identical to SEQ ID NO: 535
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1175 - DNA, 66 bp, synthetic construct; identical to SEQ ID NO: 536
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1176 - DNA, 62 bp, synthetic construct; identical to SEQ ID NO: 537
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1177 - DNA, 62 bp, synthetic construct; identical to SEQ ID NO: 538
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1178 - DNA, 62 bp, synthetic construct; identical to SEQ ID NO: 539
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1179 - DNA, 62 bp, synthetic construct; identical to SEQ ID NO: 540
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1180 - DNA, 62 bp, synthetic construct; identical to SEQ ID NO: 541
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1181 - DNA, 62 bp, synthetic construct; identical to SEQ ID NO: 542
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1182 - DNA, 62 bp, synthetic construct; identical to SEQ ID NO: 543
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1183 - DNA, 62 bp, synthetic construct; identical to SEQ ID NO: 544
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 1184 - DNA, 62 bp, synthetic construct; identical to SEQ ID NO: 545
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 1185 - DNA, 62 bp, synthetic construct; identical to SEQ ID NO: 546
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1186 - DNA, 62 bp, synthetic construct; identical to SEQ ID NO: 547
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1187 - DNA, 64 bp, synthetic construct; identical to SEQ ID NO: 548
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1188 - DNA, 64 bp, synthetic construct; identical to SEQ ID NO: 549
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1189 - DNA, 64 bp, synthetic construct; identical to SEQ ID NO: 550
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 1190 - DNA, 64 bp, synthetic construct; identical to SEQ ID NO: 551
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 1191 - DNA, 66 bp, synthetic construct; identical to SEQ ID NO: 552
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1192 - DNA, 66 bp, synthetic construct; identical to SEQ ID NO: 553
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1193 - DNA, 66 bp, synthetic construct; identical to SEQ ID NO: 554
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1194 - DNA, 66 bp, synthetic construct; identical to SEQ ID NO: 555
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1195 - DNA, 68 bp, synthetic construct; identical to SEQ ID NO: 556
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1196 - DNA, 68 bp, synthetic construct; identical to SEQ ID NO: 557
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1197 - DNA, 68 bp, synthetic construct; identical to SEQ ID NO: 558
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1198 - DNA, 68 bp, synthetic construct; identical to SEQ ID NO: 559
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1199 - DNA, 68 bp, synthetic construct; identical to SEQ ID NO: 560
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1200 - DNA, 68 bp, synthetic construct; identical to SEQ ID NO: 561
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1201 - DNA, 68 bp, synthetic construct; identical to SEQ ID NO: 562
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 1202 - DNA, 68 bp, synthetic construct; identical to SEQ ID NO: 563
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 1203 - DNA, 68 bp, synthetic construct; identical to SEQ ID NO: 564
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1204 - DNA, 68 bp, synthetic construct; identical to SEQ ID NO: 565
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1205 - DNA, 68 bp, synthetic construct; identical to SEQ ID NO: 566
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1206 - DNA, 68 bp, synthetic construct; identical to SEQ ID NO: 567
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 1207 - DNA, 66 bp, synthetic construct; identical to SEQ ID NO: 568
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1208 - DNA, 66 bp, synthetic construct; identical to SEQ ID NO: 569
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1209 - DNA, 66 bp, synthetic construct; identical to SEQ ID NO: 570
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1210 - DNA, 66 bp, synthetic construct; identical to SEQ ID NO: 571
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1211 - DNA, 66 bp, synthetic construct; identical to SEQ ID NO: 572
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1212 - DNA, 66 bp, synthetic construct; identical to SEQ ID NO: 573
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1213 - DNA, 66 bp, synthetic construct; identical to SEQ ID NO: 574
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1214 - DNA, 66 bp, synthetic construct; identical to SEQ ID NO: 575
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1215 - DNA, 66 bp, synthetic construct; identical to SEQ ID NO: 576
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1216 - DNA, 66 bp, synthetic construct; identical to SEQ ID NO: 577
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1217 - DNA, 66 bp, synthetic construct; identical to SEQ ID NO: 578
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1218 - DNA, 66 bp, synthetic construct; identical to SEQ ID NO: 579
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1219 - DNA, 66 bp, synthetic construct; identical to SEQ ID NO: 580
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1220 - DNA, 66 bp, synthetic construct; identical to SEQ ID NO: 581
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1221 - DNA, 66 bp, synthetic construct; identical to SEQ ID NO: 582
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1222 - DNA, 66 bp, synthetic construct; identical to SEQ ID NO: 583
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1223 - DNA, 62 bp, synthetic construct; identical to SEQ ID NO: 584
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1224 - DNA, 62 bp, synthetic construct; identical to SEQ ID NO: 585
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 1225 - DNA, 62 bp, synthetic construct; identical to SEQ ID NO: 586
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1226 - DNA, 62 bp, synthetic construct; identical to SEQ ID NO: 587
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1227 - DNA, 62 bp, synthetic construct; identical to SEQ ID NO: 588
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1228 - DNA, 62 bp, synthetic construct; identical to SEQ ID NO: 589
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 1229 - DNA, 62 bp, synthetic construct; identical to SEQ ID NO: 590
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1230 - DNA, 62 bp, synthetic construct; identical to SEQ ID NO: 591
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1231 - DNA, 62 bp, synthetic construct; identical to SEQ ID NO: 592
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1232 - DNA, 62 bp, synthetic construct; identical to SEQ ID NO: 593
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1233 - DNA, 62 bp, synthetic construct; identical to SEQ ID NO: 594
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 1234 - DNA, 68 bp, synthetic construct; identical to SEQ ID NO: 595
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1235 - DNA, 68 bp, synthetic construct; identical to SEQ ID NO: 596
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1236 - DNA, 68 bp, synthetic construct; identical to SEQ ID NO: 597
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1237 - DNA, 68 bp, synthetic construct; identical to SEQ ID NO: 598
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1238 - DNA, 66 bp, synthetic construct; identical to SEQ ID NO: 599
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1239 - DNA, 66 bp, synthetic construct; identical to SEQ ID NO: 600
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1240 - DNA, 66 bp, synthetic construct; identical to SEQ ID NO: 601
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1241 - DNA, 66 bp, synthetic construct; identical to SEQ ID NO: 602
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1242 - DNA, 66 bp, synthetic construct; identical to SEQ ID NO: 603
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Adenine phosphorothioate
  modified_base 63: mod_base = OTHER; note = Thymine phosphorothioate

SEQ ID NO: 1243 - DNA, 66 bp, synthetic construct; identical to SEQ ID NO: 604
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1244 - DNA, 64 bp, synthetic construct; identical to SEQ ID NO: 605
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1245 - DNA, 64 bp, synthetic construct; identical to SEQ ID NO: 606
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Guanosine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate
  modified_base 62: mod_base = OTHER; note = Adenine phosphorothioate

SEQ ID NO: 1246 - DNA, 66 bp, synthetic construct; identical to SEQ ID NO: 607
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1247 - DNA, 66 bp, synthetic construct; identical to SEQ ID NO: 608
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1248 - DNA, 62 bp, synthetic construct; identical to SEQ ID NO: 609
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1249 - DNA, 62 bp, synthetic construct; identical to SEQ ID NO: 610
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1250 - DNA, 62 bp, synthetic construct; identical to SEQ ID NO: 611
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 1251 - DNA, 62 bp, synthetic construct; identical to SEQ ID NO: 612
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 1252 - DNA, 62 bp, synthetic construct; identical to SEQ ID NO: 613
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 1253 - DNA, 62 bp, synthetic construct; identical to SEQ ID NO: 614
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1254 - DNA, 62 bp, synthetic construct; identical to SEQ ID NO: 615
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1255 - DNA, 62 bp, synthetic construct; identical to SEQ ID NO: 616
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1256 - DNA, 62 bp, synthetic construct; identical to SEQ ID NO: 617
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1257 - DNA, 62 bp, synthetic construct; identical to SEQ ID NO: 618
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1258 - DNA, 68 bp, synthetic construct; identical to SEQ ID NO: 619
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1259 - DNA, 68 bp, synthetic construct; identical to SEQ ID NO: 620
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1260 - DNA, 68 bp, synthetic construct; identical to SEQ ID NO: 621
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1261 - DNA, 68 bp, synthetic construct; identical to SEQ ID NO: 622
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1262 - DNA, 66 bp, synthetic construct; identical to SEQ ID NO: 623
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1263 - DNA, 66 bp, synthetic construct; identical to SEQ ID NO: 624
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1264 - DNA, 66 bp, synthetic construct; identical to SEQ ID NO: 625
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1265 - DNA, 68 bp, synthetic construct; identical to SEQ ID NO: 626
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Adenine phosphorothioate
  modified_base 63: mod_base = OTHER; note = Thymine phosphorothioate
  modified_base 64: mod_base = OTHER; note = Adenine phosphorothioate

SEQ ID NO: 1266 - DNA, 66 bp, synthetic construct; identical to SEQ ID NO: 627
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1267 - DNA, 66 bp, synthetic construct; identical to SEQ ID NO: 628
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1268 - DNA, 66 bp, synthetic construct; identical to SEQ ID NO: 629
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1269 - DNA, 64 bp, synthetic construct; identical to SEQ ID NO: 630
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1270 - DNA, 64 bp, synthetic construct; identical to SEQ ID NO: 631
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1271 - DNA, 64 bp, synthetic construct; identical to SEQ ID NO: 632
  source 1..64: mol_type = other DNA
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Guanosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1272 - DNA, 62 bp, synthetic construct; identical to SEQ ID NO: 633
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1273 - DNA, 62 bp, synthetic construct; identical to SEQ ID NO: 634
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1274 - DNA, 62 bp, synthetic construct; identical to SEQ ID NO: 635
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1275 - DNA, 62 bp, synthetic construct; identical to SEQ ID NO: 636
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1276 - DNA, 62 bp, synthetic construct; identical to SEQ ID NO: 637
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 1277 - DNA, 68 bp, synthetic construct; identical to SEQ ID NO: 638
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1278 - DNA, 68 bp, synthetic construct; identical to SEQ ID NO: 639
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1279 - DNA, 68 bp, synthetic construct; identical to SEQ ID NO: 640
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1280 - DNA, 68 bp, synthetic construct; identical to SEQ ID NO: 641
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1281 - DNA, 66 bp, synthetic construct; identical to SEQ ID NO: 642
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1282 - DNA, 66 bp, synthetic construct; identical to SEQ ID NO: 643
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1283 - DNA, 66 bp, synthetic construct; identical to SEQ ID NO: 644
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1284 - DNA, 66 bp, synthetic construct; identical to SEQ ID NO: 645
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1285 - DNA, 70 bp, synthetic construct; identical to SEQ ID NO: 646
  source 1..70: mol_type = other DNA
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1286 - DNA, 62 bp, synthetic construct; identical to SEQ ID NO: 647
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1287 - DNA, 62 bp, synthetic construct; identical to SEQ ID NO: 648
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1288 - DNA, 62 bp, synthetic construct; identical to SEQ ID NO: 649
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 1289 - DNA, 66 bp, synthetic construct; identical to SEQ ID NO: 650
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1290 - DNA, 66 bp, synthetic construct; identical to SEQ ID NO: 651
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1291 - DNA, 66 bp, synthetic construct; identical to SEQ ID NO: 652
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1292 - DNA, 52 bp, synthetic construct
  source 1..52: mol_type = other DNA
tatatattattttattttaatcgagtctttttgactcgatatacaatatata

SEQ ID NO: 1293 - DNA, 52 bp, synthetic construct
  source 1..52: mol_type = other DNA
gatatattattttattttaatcgagtctttttgactcgatatacaatatatc

SEQ ID NO: 1294 - DNA, 52 bp, synthetic construct
  source 1..52: mol_type = other DNA
gatatatcattttattttaatcgagtctttttgactcgatatacgatatatc

SEQ ID NO: 1295 - DNA, 52 bp, synthetic construct
  source 1..52: mol_type = other DNA
gatatgtcattttattttaatcgagtctttttgactcgatatacgacatatc

SEQ ID NO: 1296 - DNA, 52 bp, synthetic construct
  source 1..52: mol_type = other DNA
gtgatgtcattttattttaatcgagtctttttgactcgatatacgacatcac

SEQ ID NO: 1297 - DNA, 52 bp, synthetic construct
  source 1..52: mol_type = other DNA
tatatattattttattttatgcgagtctttttgactcgcagcccaatatata

SEQ ID NO: 1298 - DNA, 52 bp, synthetic construct
  source 1..52: mol_type = other DNA
gatatattattttattttatgcgagtctttttgactcgcagcccaatatatc

SEQ ID NO: 1299 - DNA, 52 bp, synthetic construct
  source 1..52: mol_type = other DNA
gatatatcattttattttatgcgagtctttttgactcgcagcccgatatatc

SEQ ID NO: 1300 - DNA, 52 bp, synthetic construct
  source 1..52: mol_type = other DNA
gatatgtcattttattttatgcgagtctttttgactcgcagcccgacatatc

SEQ ID NO: 1301 - DNA, 52 bp, synthetic construct
  source 1..52: mol_type = other DNA
gtgatgtcattttattttatgcgagtctttttgactcgcagcccgacatcac

SEQ ID NO: 1302 - DNA, 47 bp, synthetic construct
  source 1..47: mol_type = other DNA
tatatattattttattttagtatatcggactcgatatacaatatata

SEQ ID NO: 1303 - DNA, 47 bp, synthetic construct
  source 1..47: mol_type = other DNA
gatatattattttattttagtatatcggactcgatatacaatatatc

SEQ ID NO: 1304 - DNA, 47 bp, synthetic construct
  source 1..47: mol_type = other DNA
gatatatcattttattttagtatatcggactcgatatacgatatatc

SEQ ID NO: 1305 - DNA, 47 bp, synthetic construct
  source 1..47: mol_type = other DNA
gatatgtcattttattttagtatatcggactcgatatacgacatatc

SEQ ID NO: 1306 - DNA, 47 bp, synthetic construct
  source 1..47: mol_type = other DNA
gtgatgtcattttattttagtatatcggactcgatatacgacatcac

SEQ ID NO: 1307 - DNA, 47 bp, synthetic construct
  source 1..47: mol_type = other DNA
tatatattattttattttagggctgcggactcgcagcccaatatata

SEQ ID NO: 1308 - DNA, 47 bp, synthetic construct
  source 1..47: mol_type = other DNA
gatatattattttattttagggctgcggactcgcagcccaatatatc

SEQ ID NO: 1309 - DNA, 47 bp, synthetic construct
  source 1..47: mol_type = other DNA
gatatatcattttattttagggctgcggactcgcagcccgatatatc

SEQ ID NO: 1310 - DNA, 47 bp, synthetic construct
  source 1..47: mol_type = other DNA
gatatgtcattttattttagggctgcggactcgcagcccgacatatc

SEQ ID NO: 1311 - DNA, 47 bp, synthetic construct
  source 1..47: mol_type = other DNA
gtgatgtcattttattttagggctgcggactcgcagcccgacatcac

SEQ ID NO: 1312 - DNA, 41 bp, synthetic construct
  source 1..41: mol_type = other DNA
tatatatattattactatatggactcgcatatagatatata

SEQ ID NO: 1313 - DNA, 41 bp, synthetic construct
  source 1..41: mol_type = other DNA
gatatatattattactatatggactcgcatatagatatatc

SEQ ID NO: 1314 - DNA, 41 bp, synthetic construct
  source 1..41: mol_type = other DNA
gatatacattattactatatggactcgcatataggtatatc

SEQ ID NO: 1315 - DNA, 41 bp, synthetic construct
  source 1..41: mol_type = other DNA
gatatccattattactatatggactcgcatatagggatatc

SEQ ID NO: 1316 - DNA, 41 bp, synthetic construct
  source 1..41: mol_type = other DNA
gtgatacattattactatatggactcgcatataggtatcac

SEQ ID NO: 1317 - DNA, 41 bp, synthetic construct
  source 1..41: mol_type = other DNA
tatatattttatttcgggctggactcgcagcccgatatata

SEQ ID NO: 1318 - DNA, 41 bp, synthetic construct
  source 1..41: mol_type = other DNA
gatatatattattacgggctggactcgcagcccgatatatc

SEQ ID NO: 1319 - DNA, 41 bp, synthetic construct
  source 1..41: mol_type = other DNA
gatatacattattacgggctggactcgcagcccggtatatc

SEQ ID NO: 1320 - DNA, 41 bp, synthetic construct
  source 1..41: mol_type = other DNA
gatatccattattacgggctggactcgcagcccgggatatc

SEQ ID NO: 1321 - DNA, 41 bp, synthetic construct
  source 1..41: mol_type = other DNA
gtgatacattattacgggctggactcgcagcccggtatcac

SEQ ID NO: 1322 - DNA, 58 bp, synthetic construct
  source 1..58: mol_type = other DNA
tatatattttatttctatatgtttatttcgagtcttttgactcgcatatagatatata

SEQ ID NO: 1323 - DNA, 58 bp, synthetic construct
  source 1..58: mol_type = other DNA
gatatatattattactatatgattattacgagtcttttgactcgcatatagatatatc

SEQ ID NO: 1324 - DNA, 58 bp, synthetic construct
  source 1..58: mol_type = other DNA
gatatacattattactatatgattattacgagtcttttgactcgcatataggtatatc

SEQ ID NO: 1325 - DNA, 58 bp, synthetic construct
  source 1..58: mol_type = other DNA
gatatccattattactatatgattattacgagtcttttgactcgcatatagggatatc

SEQ ID NO: 1326 - DNA, 58 bp, synthetic construct
  source 1..58: mol_type = other DNA
gtgatacattattactatatgattattacgagtcttttgactcgcatataggtatcac

SEQ ID NO: 1327 - DNA, 58 bp, synthetic construct
  source 1..58: mol_type = other DNA
tatatatattattacgggctgattattacgagtcttttgactcgcagcccgatatata

SEQ ID NO: 1328 - DNA, 58 bp, synthetic construct
  source 1..58: mol_type = other DNA
gatatatattattacgggctgattattacgagtcttttgactcgcagcccgatatatc

SEQ ID NO: 1329 - DNA, 58 bp, synthetic construct
  source 1..58: mol_type = other DNA
gatatacattattacgggctgattattacgagtcttttgactcgcagcccggtatatc

SEQ ID NO: 1330 - DNA, 58 bp, synthetic construct
  source 1..58: mol_type = other DNA
gatatccattattacgggctgattattacgagtcttttgactcgcagcccgggatatc

SEQ ID NO: 1331 - DNA, 58 bp, synthetic construct
  source 1..58: mol_type = other DNA
gtgatacattattacgggctgattattacgagtcttttgactcgcagcccggtatcac

SEQ ID NO: 1332 - DNA, 39 bp, synthetic construct
  source 1..39: mol_type = other DNA
tatatatttatttcatatcgactcgcagatatgtatata

SEQ ID NO: 1333 - DNA, 39 bp, synthetic construct
  source 1..39: mol_type = other DNA
gatatcattattacatatcgactcgcagatatggatatc

SEQ ID NO: 1334 - DNA, 39 bp, synthetic construct
  source 1..39: mol_type = other DNA
gtgatcattattacatatcgactcgcagatatggatcac

SEQ ID NO: 1335 - DNA, 39 bp, synthetic construct
  source 1..39: mol_type = other DNA
gtgtgcattattacatatcgactcgcagatatggcacac

SEQ ID NO: 1336 - DNA, 39 bp, synthetic construct
  source 1..39: mol_type = other DNA
gatatcattattaccgggcgactcgcagcccgggatatc

SEQ ID NO: 1337 - DNA, 39 bp, synthetic construct
  source 1..39: mol_type = other DNA
gtgatcattattaccgggcgactcgcagcccgggatcac

SEQ ID NO: 1338 - DNA, 39 bp, synthetic construct
  source 1..39: mol_type = other DNA
gtgtgcattattaccgggcgactcgcagcccgggcacac

SEQ ID NO: 1339 - DNA, 58 bp, synthetic construct
  source 1..58: mol_type = other DNA
tatatatttatttcatatctttattttgcgagtcttttgactcgcagatatgtatata

SEQ ID NO: 1340 - DNA, 58 bp, synthetic construct
  source 1..58: mol_type = other DNA
gatatcattattacatatcattattatgcgagtcttttgactcgcagatatggatatc

SEQ ID NO: 1341 - DNA, 58 bp, synthetic construct
  source 1..58: mol_type = other DNA
gtgatcattattacatatcattattatgcgagtcttttgactcgcagatatggatcac

SEQ ID NO: 1342 - DNA, 58 bp, synthetic construct
  source 1..58: mol_type = other DNA
gtgtgcattattacatatcattattatgcgagtcttttgactcgcagatatggcacac

SEQ ID NO: 1343 - DNA, 58 bp, synthetic construct
  source 1..58: mol_type = other DNA
gatatcattattaccgggcattattatgcgagtcttttgactcgcagcccgggatatc

SEQ ID NO: 1344 - DNA, 58 bp, synthetic construct
  source 1..58: mol_type = other DNA
gtgatcattattaccgggcattattatgcgagtcttttgactcgcagcccgggatcac

SEQ ID NO: 1345 - DNA, 58 bp, synthetic construct
  source 1..58: mol_type = other DNA
gtgtgcattattaccgggcattattatgcgagtcttttgactcgcagcccgggcacac

SEQ ID NO: 1346 - DNA, 37 bp, synthetic construct
  source 1..37: mol_type = other DNA
gtatgattattacacaggactcgcagcctgtgcatac

SEQ ID NO: 1347 - DNA, 37 bp, synthetic construct
  source 1..37: mol_type = other DNA
gtgtgattattacacaggactcgcagcctgtgcacac

SEQ ID NO: 1348 - DNA, 37 bp, synthetic construct
  source 1..37: mol_type = other DNA
gtatgattattacccgggactcgcagcccgggcatac

SEQ ID NO: 1349 - DNA, 37 bp, synthetic construct
  source 1..37: mol_type = other DNA
gtgtgattattacccgggactcgcagcccgggcacac

SEQ ID NO: 1350 - DNA, 65 bp, synthetic construct
  source 1..65: mol_type = other DNA
gtatgattattacacagattattagctgcattattagagtcttttgactcgcagcctgtgcatac

SEQ ID NO: 1351 - DNA, 65 bp, synthetic construct
  source 1..65: mol_type = other DNA
gtgtgattattacacagattattagctgcattattagagtcttttgactcgcagcctgtgcacac

SEQ ID NO: 1352 - DNA, 65 bp, synthetic construct
  source 1..65: mol_type = other DNA
tatatattattacccggattattagctgcattattagagtcttttgactcgcagcccgggatata

SEQ ID NO: 1353 - DNA, 65 bp, synthetic construct
  source 1..65: mol_type = other DNA
gatatattattacccggattattagctgcattattagagtcttttgactcgcagcccgggatatc

SEQ ID NO: 1354 - DNA, 65 bp, synthetic construct
  source 1..65: mol_type = other DNA
gtatgattattacccggattattagctgcattattagagtcttttgactcgcagcccgggcatac

SEQ ID NO: 1355 - DNA, 65 bp, synthetic construct
  source 1..65: mol_type = other DNA
gtgtgattattacccggattattagctgcattattagagtcttttgactcgcagcccgggcacac

SEQ ID NO: 1356 - DNA, 69 bp, synthetic construct
  source 1..69: mol_type = other DNA
gactcgatatacaatatatagcgcgcgcaataagcgcgcattattagctatataattattattgtatat

SEQ ID NO: 1357 - DNA, 69 bp, synthetic construct
  source 1..69: mol_type = other DNA
gactcgatatacaatatatcgcgcgcgcaataagcgcgcattattagcgatataattattattgtatat

SEQ ID NO: 1358 - DNA, 69 bp, synthetic construct
  source 1..69: mol_type = other DNA
gactcgatatacgatatatcgcgcgcgcaataagcgcgcattattagcgatataattattatcgtatat

SEQ ID NO: 1359 - DNA, 69 bp, synthetic construct
  source 1..69: mol_type = other DNA
gactcgatatacgacatatcgcgcgcgcaataagcgcgcattattagcgatatgattattatcgtatat

SEQ ID NO: 1360 - DNA, 69 bp, synthetic construct
  source 1..69: mol_type = other DNA
gactcgatatacgacatcacgcgcgcgcaataagcgcgcattattagcgtgatgattattatcgtatat

SEQ ID NO: 1361 - DNA, 69 bp, synthetic construct
  source 1..69: mol_type = other DNA
gactcgcagcccaatatatagcgcgcgcaataagcgcgcattattagctatataattattattgggctg

SEQ ID NO: 1362 - DNA, 69 bp, synthetic construct
  source 1..69: mol_type = other DNA
gactcgcagcccaatatatcgcgcgcgcaataagcgcgcattattagcgatataattattattgggctg

SEQ ID NO: 1363 - DNA, 69 bp, synthetic construct
  source 1..69: mol_type = other DNA
gactcgcagcccgatatatcgcgcgcgcaataagcgcgcattattagcgatataattattatcgggctg

SEQ ID NO: 1364 - DNA, 69 bp, synthetic construct
  source 1..69: mol_type = other DNA
gactcgcagcccgacatatcgcgcgcgcaataagcgcgcattattagcgatatgattattatcgggctg

SEQ ID NO: 1365 - DNA, 69 bp, synthetic construct
  source 1..69: mol_type = other DNA
gactcgcagcccgacatcacgcgcgcgcaataagcgcgcattattagcgtgatgattattatcgggctg

SEQ ID NO: 1366 - DNA, 82 bp, synthetic construct
  source 1..82: mol_type = other DNA
gactcgatatacaatatatagcgcgcgcaataagcgcgcattattagctatataattattattgtatattattaatcgagtc

SEQ ID NO: 1367 - DNA, 82 bp, synthetic construct
  source 1..82: mol_type = other DNA
gactcgatatacaatatatcgcgcgcgcaataagcgcgcattattagcgatataattattattgtatattattaatcgagtc

SEQ ID NO: 1368 - DNA, 82 bp, synthetic construct
  source 1..82: mol_type = other DNA
gactcgatatacgatatatcgcgcgcgcaataagcgcgcattattagcgatataattattatcgtatattattaatcgagtc

SEQ ID NO: 1369 - DNA, 82 bp, synthetic construct
  source 1..82: mol_type = other DNA
gactcgatatacgacatatcgcgcgcgcaataagcgcgcattattagcgatatgattattatcgtatattattaatcgagtc

SEQ ID NO: 1370 - DNA, 82 bp, synthetic construct
  source 1..82: mol_type = other DNA
gactcgatatacgacatcacgcgcgcgcaataagcgcgcattattagcgtgatgattattatcgtatattattaatcgagtc

SEQ ID NO: 1371 - DNA, 82 bp, synthetic construct
  source 1..82: mol_type = other DNA
gactcgcagcccaatatatagcgcgcgcaataagcgcgcattattagctatataattattattgggcattattatgcgagtc

SEQ ID NO: 1372 - DNA, 82 bp, synthetic construct
  source 1..82: mol_type = other DNA
gactcgcagcccaatatatcgcgcgcgcaataagcgcgcattattagcgatataattattattgggcattattatgcgagtc

SEQ ID NO: 1373 - DNA, 82 bp, synthetic construct
  source 1..82: mol_type = other DNA
gactcgcagcccgatatatcgcgcgcgcaataagcgcgcattattagcgatataattattatcgggcattattatgcgagtc

SEQ ID NO: 1374 - DNA, 82 bp, synthetic construct
  source 1..82: mol_type = other DNA
gactcgcagcccgacatatcgcgcgcgcaataagcgcgcattattagcgatatgattattatcgggcattattatgcgagtc

SEQ ID NO: 1375 - DNA, 82 bp, synthetic construct
  source 1..82: mol_type = other DNA
gactcgcagcccgacatcacgcgcgcgcaataagcgcgcattattagcgtgatgattattatcgggcattattatgcgagtc

SEQ ID NO: 1376 - DNA, 67 bp, synthetic construct
  source 1..67: mol_type = other DNA
gactcgcatatagatatatagcgcgcgcaataagcgcgcattattagctatatattattaatctata

SEQ ID NO: 1377 - DNA, 67 bp, synthetic construct
  source 1..67: mol_type = other DNA
gactcgcatatagatatatcgcgcgcgcaataagcgcgcattattagcgatatattattaatctata

SEQ ID NO: 1378 - DNA, 67 bp, synthetic construct
  source 1..67: mol_type = other DNA
gactcgcatataggtatatcgcgcgcgcaataagcgcgcattattagcgatatattattaacctata

SEQ ID NO: 1379 - DNA, 67 bp, synthetic construct
  source 1..67: mol_type = other DNA
gactcgcatatagggatatcgcgcgcgcaataagcgcgcattattagcgatatattattaccctata

SEQ ID NO: 1380 - DNA, 67 bp, synthetic construct
  source 1..67: mol_type = other DNA
gactcgcatataggtatcacgcgcgcgcaataagcgcgcattattagcgtgatattattaacctata

SEQ ID NO: 1381 - DNA, 67 bp, synthetic construct
  source 1..67: mol_type = other DNA
gactcgcagcccgatatatagcgcgcgcaataagcgcgcattattagctatatattattaatcgggc

SEQ ID NO: 1382 - DNA, 67 bp, synthetic construct
  source 1..67: mol_type = other DNA
gactcgcagcccgatatatcgcgcgcgcaataagcgcgcattattagcgatatattattaatcgggc

SEQ ID NO: 1383 - DNA, 67 bp, synthetic construct
  source 1..67: mol_type = other DNA
gactcgcagcccggtatatcgcgcgcgcaataagcgcgcattattagcgatatattattaaccgggc

SEQ ID NO: 1384 - DNA, 67 bp, synthetic construct
  source 1..67: mol_type = other DNA
gactcgcagcccgggatatcgcgcgcgcaataagcgcgcattattagcgatatattattacccgggc

SEQ ID NO: 1385 - DNA, 67 bp, synthetic construct
  source 1..67: mol_type = other DNA
gactcgcagcccggtatcacgcgcgcgcaataagcgcgcattattagcgtgatattattaaccgggc

SEQ ID NO: 1386 - DNA, 81 bp, synthetic construct
  source 1..81: mol_type = other DNA
gactcgcatatagatatatagcgcgcgcaataagcgcgcattattagctatatattattaatctataattattatgcgagt

SEQ ID NO: 1387 - DNA, 81 bp, synthetic construct
  source 1..81: mol_type = other DNA
gactcgcatatagatatatcgcgcgcgcaataagcgcgcattattagcgatatattattaatctataattattatgcgagt

SEQ ID NO: 1388 - DNA, 81 bp, synthetic construct
  source 1..81: mol_type = other DNA
gactcgcatataggtatatcgcgcgcgcaataagcgcgcattattagcgatatattattaacctataattattatgcgagt

SEQ ID NO: 1389 - DNA, 81 bp, synthetic construct
  source 1..81: mol_type = other DNA
gactcgcatatagggatatcgcgcgcgcaataagcgcgcattattagcgatatattattaccctataattattatgcgagt

SEQ ID NO: 1390 - DNA, 81 bp, synthetic construct
  source 1..81: mol_type = other DNA
gactcgcatataggtatcacgcgcgcgcaataagcgcgcattattagcgtgatattattaacctataattattatgcgagt

SEQ ID NO: 1391 - DNA, 81 bp, synthetic construct
  source 1..81: mol_type = other DNA
gactcgcagcccgatatatagcgcgcgcaataagcgcgcattattagctatatattattaatcgggcattattatgcgagt

SEQ ID NO: 1392 - DNA, 81 bp, synthetic construct
  source 1..81: mol_type = other DNA
gactcgcagcccgatatatcgcgcgcgcaataagcgcgcattattagcgatatattattaatcgggcattattatgcgagt

SEQ ID NO: 1393 - DNA, 81 bp, synthetic construct
  source 1..81: mol_type = other DNA
gactcgcagcccggtatatcgcgcgcgcaataagcgcgcattattagcgatatattattaaccgggcattattatgcgagt

SEQ ID NO: 1394 - DNA, 81 bp, synthetic construct
  source 1..81: mol_type = other DNA
gactcgcagcccgggatatcgcgcgcgcaataagcgcgcattattagcgatatattattacccgggcattattatgcgagt

SEQ ID NO: 1395 - DNA, 81 bp, synthetic construct
  source 1..81: mol_type = other DNA
gactcgcagcccggtatcacgcgcgcgcaataagcgcgcattattagcgtgatattattaaccgggcattattatgcgagt

SEQ ID NO: 1396 - DNA, 65 bp, synthetic construct
  source 1..65: mol_type = other DNA
gactcgcagatatgtatatagcgcgcgcaataagcgcgcattattagctataattattatacata

SEQ ID NO: 1397 - DNA, 65 bp, synthetic construct
  source 1..65: mol_type = other DNA
gactcgcagatatgtatatcgcgcgcgcaataagcgcgcattattagcgataattattatacata

SEQ ID NO: 1398 - DNA, 65 bp, synthetic construct
  source 1..65: mol_type = other DNA
gactcgcagatatggatatcgcgcgcgcaataagcgcgcattattagcgataattattatccata

SEQ ID NO: 1399 - DNA, 65 bp, synthetic construct
  source 1..65: mol_type = other DNA
gactcgcagatatggatcacgcgcgcgcaataagcgcgcattattagcgtgaattattatccata

SEQ ID NO: 1400 - DNA, 65 bp, synthetic construct
  source 1..65: mol_type = other DNA
gactcgcagatatggcacacgcgcgcgcaataagcgcgcattattagcgtgtattattagccata

SEQ ID NO: 1401 - DNA, 65 bp, synthetic construct
  source 1..65: mol_type = other DNA
gactcgcagcccggtatatagcgcgcgcaataagcgcgcattattagctataattattataccgg

SEQ ID NO: 1402 - DNA, 65 bp, synthetic construct
  source 1..65: mol_type = other DNA
gactcgcagcccggtatatcgcgcgcgcaataagcgcgcattattagcgataattattataccgg

SEQ ID NO: 1403 - DNA, 65 bp, synthetic construct
  source 1..65: mol_type = other DNA
gactcgcagcccgggatatcgcgcgcgcaataagcgcgcattattagcgataattattatcccgg

SEQ ID NO: 1404 - DNA, 65 bp, synthetic construct
  source 1..65: mol_type = other DNA
gactcgcagcccgggatcacgcgcgcgcaataagcgcgcattattagcgtgaattattatcccgg

SEQ ID NO: 1405 - DNA, 65 bp, synthetic construct
  source 1..65: mol_type = other DNA
gactcgcagcccgggcacacgcgcgcgcaataagcgcgcattattagcgtgtattattagcccgg

SEQ ID NO: 1406 - DNA, 63 bp, synthetic construct
  source 1..63: mol_type = other DNA
gactcgcagcctgtgatatagcgcgcgcaataagcgcgcattattagctatattattaatcac

SEQ ID NO: 1407 - DNA, 63 bp, synthetic construct
  source 1..63: mol_type = other DNA
gactcgcagcctgtgatatcgcgcgcgcaataagcgcgcattattagcgatattattaatcac

SEQ ID NO: 1408 - DNA, 63 bp, synthetic construct
  source 1..63: mol_type = other DNA
gactcgcagcctgtgcatacgcgcgcgcaataagcgcgcattattagcgtaattattatgcac

SEQ ID NO: 1409 - DNA, 63 bp, synthetic construct
  source 1..63: mol_type = other DNA
gactcgcagcctgtgcacacgcgcgcgcaataagcgcgcattattagcgtgattattatgcac

SEQ ID NO: 1410 - DNA, 63 bp, synthetic construct
  source 1..63: mol_type = other DNA
gactcgcagcccgggatatagcgcgcgcaataagcgcgcattattagctatattattaatccc

SEQ ID NO: 1411 - DNA, 63 bp, synthetic construct
  source 1..63: mol_type = other DNA
gactcgcagcccgggatatcgcgcgcgcaataagcgcgcattattagcgatattattaatccc

SEQ ID NO: 1412 - DNA, 63 bp, synthetic construct
  source 1..63: mol_type = other DNA
gactcgcagcccgggcatacgcgcgcgcaataagcgcgcattattagcgtaattattatgccc

SEQ ID NO: 1413 - DNA, 63 bp, synthetic construct
  source 1..63: mol_type = other DNA
gactcgcagcccgggcacacgcgcgcgcaataagcgcgcattattagcgtgattattatgccc

SEQ ID NO: 1414 - DNA, 87 bp, synthetic construct
  source 1..87: mol_type = other DNA
gactcgcagcctgtgatatagcgcgcgcaataagcgcgcattattagctatattattaatcacattattaaggctattattagcgag

SEQ ID NO: 1415 - DNA, 87 bp, synthetic construct
  source 1..87: mol_type = other DNA
gactcgcagcctgtgatatcgcgcgcgcaataagcgcgcattattagcgatattattaatcacattattaaggctattattagcgag

SEQ ID NO: 1416 - DNA, 87 bp, synthetic construct
  source 1..87: mol_type = other DNA
gactcgcagcctgtgcatacgcgcgcgcaataagcgcgcattattagcgtaattattatgcacattattaaggctattattagcgag

SEQ ID NO: 1417 - DNA, 87 bp, synthetic construct
  source 1..87: mol_type = other DNA
gactcgcagcctgtgcacacgcgcgcgcaataagcgcgcattattagcgtgattattatgcacattattaaggctattattagcgag

SEQ ID NO: 1418 - DNA, 87 bp, synthetic construct
  source 1..87: mol_type = other DNA
gactcgcagcccgggatatagcgcgcgcaataagcgcgcattattagctatattattaatcccattattagggctattattagcgag

SEQ ID NO: 1419 - DNA, 87 bp, synthetic construct
  source 1..87: mol_type = other DNA
gactcgcagcccgggatatcgcgcgcgcaataagcgcgcattattagcgatattattaatcccattattagggctattattagcgag

SEQ ID NO: 1420 - DNA, 87 bp, synthetic construct
  source 1..87: mol_type = other DNA
gactcgcagcccgggcatacgcgcgcgcaataagcgcgcattattagcgtaattattatgcccattattagggctattattagcgag

SEQ ID NO: 1421 - DNA, 87 bp, synthetic construct
  source 1..87: mol_type = other DNA
gactcgcagcccgggcacacgcgcgcgcaataagcgcgcattattagcgtgattattatgcccattattagggctattattagcgag

We claim:

1. A composition of matter comprising a ribonucleoprotein (RNP) complex and a blocked nucleic acid molecule, wherein the blocked nucleic acid molecule is represented by Formula I, wherein Formula I in the 5'-to-3' direction comprises:

A-(B-L)J-C-M-T-D;

wherein A is 0-15 nucleotides in length;
B is 4-12 nucleotides in length;
L is 3-25 nucleotides in length;
J is an integer between 1 and 10;
C is 4-15 nucleotides in length;
M is 1-25 nucleotides in length or is absent, wherein if M is absent then A-(B-L)j-C and T-D are separate nucleic acid strands;
T is 17-135 nucleotides in length and comprises at least 50% sequence complementarity to B and C;
D is 0-10 nucleotides in length and comprises at least 50% sequence complementarity to A; and
wherein the blocked nucleic acid molecule comprises a sequence complementary to a gRNA; and wherein the ribonucleoprotein complex comprises a nucleic acid-guided nuclease and the gRNA; and wherein the nucleic acid-guided nuclease exhibits cis-cleavage activity and trans-cleavage activity; wherein a $K_d$ of the blocked nucleic acid molecules to the RNP is about $10^5$-fold greater or more than the $K_d$ of an unblocked nucleic acid molecule resulting from unblocking of the blocked nucleic acid molecules.

2. The composition of matter of claim 1, wherein the nucleic acid-guided nuclease is a Type V nucleic acid-guided nuclease or a Type VI nucleic acid-guided nuclease.

3. The composition of matter of claim 1, wherein the nucleic acid-guided nuclease comprises a RuvC nuclease domain or a RuvC-like nuclease domain and lacks an HNH nuclease domain.

4. The composition of matter of claim 1, wherein:
(a) T of Formula I comprises at least 80% sequence complementarity to B and C; and/or
(b) D of Formula I comprises at least 80% sequence complementarity to A.

5. The composition of matter of claim 1, wherein the blocked nucleic acid molecule comprises a modified nucleoside or nucleotide.

6. The composition of matter of claim 1, wherein the blocked nucleic acid molecule does not comprise a PAM sequence.

7. The composition of matter of claim 1, wherein the blocked nucleic acid molecule comprises a PAM sequence disposed between the first and second sequences, wherein the first sequence is 5' to the PAM sequence.

8. The composition of matter of claim 1, further comprising a reporter moiety: wherein the reporter moiety comprises a DNA, RNA or chimeric nucleic acid molecule and is operably linked to the blocked nucleic acid molecule and produces a detectable signal upon cleavage by the ribonucleoprotein complex.

9. The composition of matter of claim 8, wherein the detectable signal is a fluorescent, chemiluminescent, radioactive, colorimetric or other optical signal.

10. The composition of matter of claim 9, wherein the detectable signal is the fluorescent signal.

11. The composition of matter of claim 9, wherein the detectable signal is the chemiluminescent signal.

12. The composition of matter of claim 9, wherein the detectable signal is the colorimetric signal.

13. The composition of matter of claim 9, wherein the detectable signal is the other optical signal.

14. The composition of matter of claim 8, wherein the reporter moiety comprises a modified nucleoside or nucleotide.

15. The composition of matter of claim 1, further comprising a reporter moiety: wherein the reporter moiety comprises a DNA, RNA or chimeric nucleic acid molecule and is not operably linked to the blocked nucleic acid molecule and produces a detectable signal upon cleavage by the ribonucleoprotein complex.

16. The composition of matter of claim 15, wherein the detectable signal is a fluorescent, chemiluminescent, radioactive, colorimetric or other optical signal.

17. The composition of matter of claim 16, wherein the detectable signal is the fluorescent signal.

18. The composition of matter of claim 17, wherein the reporter moiety is conjugated to the fluorescent signal and a quencher.

19. The composition of matter of claim 16, wherein the detectable signal is the chemiluminescent signal.

20. The composition of matter of claim 16, wherein the detectable signal is the radioactive signal.

21. The composition of matter of claim 16, wherein the detectable signal is the colorimetric signal.

22. The composition of matter of claim 16, wherein the detectable signal is the other optical signal.

23. The reaction mixture of claim 15, wherein the reporter moiety comprises a modified nucleoside or nucleotide.

24. The composition of matter of claim 23, wherein the modified nucleoside or nucleotide comprises a locked nucleic acid (LNA), peptide nucleic acid (PNA), 2'-O-methyl (2'-O-Me) modified nucleoside, 2'-fluoro (2'-F) modified nucleoside, and/or a phosphorothioate (PS) bond.

25. The composition of matter of claim 1, wherein a $K_d$ of the blocked nucleic acid molecules to the RNP is about $10^6$-fold greater or more than the $K_d$ of an unblocked nucleic acid molecule resulting from unblocking of the blocked nucleic acid molecules.

26. The composition of matter of claim 25, wherein a $K_d$ of the blocked nucleic acid molecules to the RNP is about $10^7$-fold greater or more than the $K_d$ of an unblocked nucleic acid molecule resulting from unblocking of the blocked nucleic acid molecules.

27. The composition of matter of claim 26, wherein a $K_d$ of the blocked nucleic acid molecules to the RNP is about $10^8$-fold greater or more than the $K_d$ of an unblocked nucleic acid molecule resulting from unblocking of the blocked nucleic acid molecules.

28. The composition of matter of claim 27, wherein a $K_d$ of the blocked nucleic acid molecules to the RNP is about $10^{10}$-fold greater or more than the $K_d$ of an unblocked nucleic acid molecule resulting from unblocking of the blocked nucleic acid molecules.

* * * * *